United States Patent 10,113,201 (METHODS AND COMPOSITIONS FOR DIAGNOSIS OF GLIOBLASTOMA OR A SUBTYPE THEREOF) - sequence listing, part 12

SEQ ID NO: 193 - DNA, 127906 bp, Homo sapiens
atggatggaatctttgctgggataatatgcaatcaagctaataggtgccttacctggacctcccaacaggtaataaatgggaaaatgttaagggggagtggttggggaagaacagtaaacttggaaaagccattctcatcagcacagaagcactgaaagaaggtacagatcttcatggtgaaaagtgggaagccttgtattagcaaggagtgatgattgacaaagacctaaggtctaatgtctaatgtgtgctggggagagtccgagaatcctgtgggtacagagaaaagtaagacattagaagtccttatgtgtgttttggagacagagtccctaagctcacctggtcagtaagtgtctcttgcatgagtgaattggacagtgcggactccattctgcaaaaagcttgattggaggcaagtggaaaggaccttggaaaattaaccaaaatgcaatgaagctctttcctaaataccaatggctaaagaacttcaacatgtcagtgttgtatgaaatacttcattggactgaattgtcctctgaatttaatgttagcattccctcaagagtcttggctttctttttttgcctgcactgtctgcattacagtgcagtaaggcagacttttcttgtgaagtggtatggataagatttagaggatctgaacacctctctgctttggaattcgtggtagctaaagtgtaaatagattcacacatctgacattcaaagtcagaaattcacgtggtcttgcactgttctggtgtgcaagttggtttcagaaggggcttggtgtttgaaaggtgctgtaaggagtggaagaatcgatgccatcttcagatgtttgttccaagtcacaagcaaaccctgcttcaaatctgctggcaaggcctttgagtcacacagagcctgacttgttcactttgtgtttgtccagcttccatggcatgtggaagaagttggtcggcttgggaatatgctgaatcaagcaacataaccaaccaatgagagggggcttaagcttctttcaagccgggcaaacctttagttgttagaagcccatacttcctatgtggtggtataggaaggacacagacttacctgtaggtttcttgccaaaaaatagaattgcgatctgatcaatcttccaactatttatagaaagtacaggccaggcttggtggctcacgcctgtaaccccagcactttgggaggcctaggccggcagatcacgaggtcaggagatcaagaccatcctggccaacatggtgaaaccccgtctctactaaaaatacaaaaattagctgggtgtggtggcatgcgcctgtaatcccagctactcgggaggctgaggcaggagaattgcttgaacctgggaatcggaggttgcagtgagccaagatcgccactgtactgcagcctggtgacagagcaagactccctctcaaaaaaaaaaaaaaaaaaaaaaaaggaaggtatggacgataaggggttcatatcaaacaacactatgggaatgaagtccatcggatttagaatgtggaaatactaaaagatgccacaccacatttcttcagtaaatacatggaaaaaaaaaagacgggggaagtggtgttaatgaaagaaactttgaagggactgtggcagatgcaattgatgttctgcctaccttcactccacttctacctctatagcttgctggaggctgtgtgccaggaacacctgtgacgctttcccctagggcatttattctgtccccaaggttacacatggtaagcggagcagagtgcccgagaattaatggcctagagagttaatgtctctggaagcagtgcttagccaaagatgggtggaaagctggtggacaaataccccagcttccttccctctatcccccagggttgggaaaactctcagtggtgccccacactgttttccagagttgtccagagagactgagcttcatttgcccccagcagtaacgaaccctttgttggtggtcctcccactgtctcactttccggctcccctaccagtttcactggggtcacctcccagttaaaccatttgcactgaaatcattgccccagggtctgtttctgggggaaaccaaagtaggacagggacaaatcaatccatggaacaagtgaaccttatttccatctggattcaaacaacccatctgccaaaaggcatttatgagttaaatgtggaaacatgatcatagatgggatattagatgattttaaataatcgttctttaatttctttaggtttgattgttgtttcttggttatttttttaaaaaagagtgcttatctgctagagatccacattgcagtatttacaaatgagatgatacgatgtctgtggtttgctttaaaataatccagtggtggtggtggaggtggaggggcaccagggaggggatccggggactataaggtgggcaaaactttaataactgttgaagctgggtgatggggacatggcagttcattacagaggttttgtggtgtatttaaaatctttcatagtaaaatgttaaagaaaacaaaaaaaagcacatgtacacctttctggtctccctcctctgaggcaaaattaaatgatcctcttcccagccatgttaccgtgacacatcggctctgtcttggggatcagtggctcagcaagtgagtccttagtgtctcagttcatggccctcctccatgctggtggccttcacctcctccattgcatccatccatcccgtagccagactggagcctttggcatcacccagacctgcttttacctgagttcttaaattccatcctgtgagctcctgccctgagcgattcctctggttctattgcagcaactttccaatctgtaacccgccatgcaatcataacccacgtggtctcgactgttaagtaccagaactgctgggcgggagggagggtgagcctggagacagaggtcaggccaggttgtgggccttctcctgtaaagagtcttcagcaattctagtgggatatccaagaggttgttgtgactttggccttggccaaacaccccaggggtgttataattggggggtgggcagccactgggagaggaagtgccaccatggctgtaagtggaagaatagaaacttcaatcgggagggatccagtacaggaagagttcagttctcagggagagagggttggagaaagcctgagtcgttgttagggcattagccaaatggccaggacttttccagagggaagctgggatataatcaggaaactagggcaggaggctaattctgcatactggatgcatgggccaggttcaggtgggtctcctgcccaaggcttgccacaggtatgccaggctttgggtggcaggaggaatggcagagctcagccactggagggaatgagcctgtgcccatggggctagtttctgatgggctcggtcactggaacaggttgggtgagggtggccatggagaacctgcaggctgaagatcttttatatttggcttatttattgagaggtctcagctctgcacatacataggaattggttttatttttgctaatcactgctttccactgtgctgaagcaagttcttctctccttctgtggagtaggactcttgaggatcctttgaccagggccatatatttcctgtcatggttaagttttaaaacctttttatttctgtatgacttagtccccctttttttttttttgaggtgagtcttgctctgtcacccaggctggagtgcaatggtgtcatcttggctcactgcaacctctgcctcccgggttcaagcgattctcctgcctcaggctcctgagtagctgggacaacaggtgtgtgccaccgtgtccagctaatttttgtacttttagtagagatggggtttcaccatgttggccaggctggtctcgaactcctggcctcaagtgattcgcttgcctccgcctccccagtgtgctgggattacaggtgtgacccaccgcacctggccgctttttgtttttaaaatatcagtttccaacctgattgacagtttgtcctcaacagcatgggcagagatgggatcctggctgctggtagcggaagagggtgctgtggtcaggctctgtgcacctcctccctctcccccttccagatgctccttcccttggtgctgggcacaggaaggacaggtggagaggcttagttctatgtgtcttccacctgcagagggtgtatgggggttcctggtcttgctgtggtccccccggttctgtctgatgctggtgtggcacctgtgtcttcctgtggtctcatctgtggtatataatcccaccctcttttcctggtgctatttcccttacccttgaagctgcctggacaggccatggctcctctcctgctgctctcccaacctgaaccttcttgttgactcagggaaaccactggagtcttctttcataccctctgagggccatagagaatggtattccttcactgaaggcaactctagtctttgcaagtggttttcttggagtccctcggaactggctttgagaaagggaaagcatcctcatcagtttcccatgagaatgtgagggaataagaaaagtagctaataggccagatgtggtggctcatgcctgtaatctcagcattttgggaggctgaggtgggtgaatcacttgaggtcaggagttcaagaccaggctggccaaaatggtaaaaccctgtctctaccaaaaatacaaagaagttagctgggcgtggtgatgcacacctgaagtcctagctacttgggaggctgaggcaggagaattgcttgaacccaggaggcggaggttgcagtgagccaagattgcaccactgcactccagcctgggtgacagactgagactcggtctcaaaagaaaaaaaaatgttgcactaaacatctttttccatgttaaggttgtctgtctgtatttaggaatggactttccttatgatagactccactctgtgatgtgaaatttgtacatcaaaggatttgaacaattctaagtacaaatttttatatgtgtgtgtgtttgtgtgtgtgtatgtgtagtacagttttaattgctcccatgatacatagtcattagagaaaacccttgttaaaaaaaaaaggagcggggaggagaaaggaggcaaagaaacacgtatatggatttgcgtcttccatttgccttgaattaaatttaatgtcattaaaaaacccactggccaggtgcagtagctcatgcctgtaatcccagaactttgggaggccagggcgggaggatcacttgaggccaggagttggagaccagcctggccaacattgcaaaaccccctctactaaaaatacaaaaattagccaggcgtggtggtgcacgtgcctgtagtctcagctactcgggaggctgaggtgggagaattgcttgaacccaggaagtggaggttgcaatgagctgagattgtgccactgcactccagcctgggcaacagagtgagattatgtctcaaaaaaaaaaaaagaaaaaaaaaagaaaaatagctaatacttacatagtgcagttctaagaatgttaaatatttcaattgatttaatccttgtgataaccatttggagtagacattagcctcattttatggactagagtggatatatatagccctacatcacacggtttataagttggcagatccaggacttgaaccttgtctttcgggcttaggtgttacatgtcactcttgtcacgctgaagggtccttcttttcctctctttatattgatttcctctcttatattgactgaatgggaggcaggggagtggtaagggcaggggaccagttttgacacctcttggaaagttgtgctgtagtagctggcatcatggctagaagcttgtcggtgactctgactgtggactattgtgagctttcagtcattagctttggaccttagctgtgattccaggtcaggaggaaagttccactcaacttgctatttctcatctagctcggcagtgttgagaggcctggctcttttcctgaagctattttccccaagctggatatcttaggacttctcttcctttcctgcctgcccagatcccatgcagggcagctccctttctcacagacccctgcaaacccctccctccactatctttcctatgtcttctgccaacctcaggccctggagccctctaacatctgtcttctctgctatacagggtctgccaggaactgctggagaaaatcttgtaattgtgctggtgttacatatttatggcttcagcttcaagataagtcactaatcctttattatgttcttgaatggcttcctcttccactctttgtcatggctcttgaagacccgttacagccccaagaccccgtggtagtagtcctaccttcttgccccttgtcttcacgctctcctttactgacacttaccttgaggttatctaccgggacatctagagcctattgttcgaggaatgcagtcttgcaagcctactctggacccgagcagctgacctcttcttccacgccccccttctcgctatctcttttaccaataaatatggagggctatgtaaagctcagggcccttgtccactagaggcaaggtgccccctgaccccttcttccaaacatatttttttgtctcttatctttattcccacattcatcctcctttgttcagtcccctaaggtctgtgcaggttacaattaagcaagttggcctcttgtttaaatccttcccttgactctctctccccttaggcctcccctgtctcactcttttcttcattgctggacttttagaaagcatatctctacccactgctttcacttcctgatcacgtatcactgtcaaccaatgtaatctactgtcccctccatcatcacacaatggatctacttcagttaagttaccaacatcttcctaaaagatgaatccagcaggcatttgtgtctttatttttgacaactctgctctgttgtggattttgaccatctccttctggaaacatcgtctactatgattcctaccacaccactgctggttaaacttttaactctctgttcactatgttttattttccagcctctctttctctgtccaactttttaaaatcagtgatcacgaggagtttgctcttggtcatctagtcttttcactcagttgatgttttgtgtatgataccatgactctcatgataacccatgtggtcacctgttcataattcctgtcctgacatttctcttgagctttaggcagcctatctggacagctctacttggacacccccacacacctcaaattagttttcaaaaaatatattttttaagtccatccaaacattttcatcactccaatttactagaaactataaaaccagccttcatctttgggcatagcactctggagctgattacctccccttcaatcctgactcctctcttgattagctgggtgagcctgggcaagtaatccactttccatgtgtcttagtttctggaaattaagcatatcttccttaaaggatggacatgaagataaaattagataataaaggcaaagctcttggcaaagggctcaatatgtagtaacttccaccaaatgctgtgttttgttattgttgccattattctattcatcattcattcaacgcttctgagtatcctcagtgattcacttggcattgtgctagggactcactccacacccttatctctctacattctgtagatttttacctcttaagtgctctaagatctgtcaatctctctctgcaccaccatcactcctcagggtggggccacattacttattatctacactgccacctctcccacctattttctctcctgctccaggccatcttcctcactgtggccagagggatcttcctaaaacaggaatggtcaccccctactgaaaatccttcagtggcccttcagtataaacttgtactgcttccatgttgtcaagcccttgtgtctgctggcctagctctagccatctggagctacttggaagtttgcacactatgccctgttgggttatccctttggaccaggtccatgttcttccttctgctgaaataagcttctcctccacctccttctattgtcctcctggtgttttgctttctcctcctttaagattctgttgaagcattacctgctgctgtaaaaattttaggaatttttacccgtttccttcctcttcccccacctgctgaggtgggggatgggttgctttgttctccgtgttcttacagcgttttatacatatcttgcctctcatgatcaggggctctatctttcttacccctaggttttttaatgtctaaggcctggaaaaggaggtttacagttagcagtattttattaaatacttaactcattaaagtcataaatgtaaaactgattctacattaaactttaaaaaataacttacaaattttataaattcatttgtaaatctgatatttatgttaaaatgaaaggcactccagcctgggcgacagagactccatctcaaaaaaaaaaaaaaaagaaaggcacttatctttgaacagtgtttaatttataaatttaaccaattaaatccctcaattaatactatttataaattctgttaatttcccttaaacattttaaagtgtagtcatacgtgtaatcatatgttcaattagtcatccagttctcacagagatccaaatctgatcaaagaaacaaatgtcattcactaaataaatgtttactgagtgcctagcatgtgtggtaactgctccaggcttggagactcagtgattaatagtcaatgaaatgaccactgaatggtaaataccgagaattgtgccaactgtaaacctgagtaaatgattattagtgttttaactagtgtcactgcaacctgagtaaagtatataaaatcctatcagtacacaggaccttagaacaaacaaatacacaacaattacacagtagggcctggccacagaatgaggagatctgaataaaatcctggaagatgacactagaacccaagagcctcgcaactccctgatatttaaaagctgcattatttcaggaaaaggtaccagtctgctgaaaaatggacacatgacactggagaagatcatctgaaagggagagggtcgggaagtcctgttgactgctgatgtggcagctatttgatgataatgaggggctgaacaaatgccagctcagatggaatcattctggaaggtgcactcacattctgagtccaggccctaatctccagtcagtaacatggagcttgactttattgtggttcccagtattttatggggtaaccacagctgacctgaggtggttattgtgctgtccttgattgggcgaactacttggaaatttgagataaggaaataaatccctggtgtcaatgcttctgtattggatataatgatagtaataagatatattgatagtaataagctttgcaggcatttttaggtgtgtgttttgttgctgcctccttttgagcccctcttcccggaccacacttttgctggagttcacagagcaggctggagttcatcaatgaagccctggaccaatgtggccttcaggccccacatgctgagccctatcaagtgccatatctctctccactattggtcttgggtgagatgctgcattgggggcctagaacctggcttctcgagtggctgtccaagggctggagggtgaaacccggaagtgttgggtctttggctcctatggtgaacctcaaccaatgggagaggataggatggcactgggcagatcaatttcccttcctttctcccttccagggactactctgaggtgcagtttcttcttgcagctctttgtgagaaagtccggtgtgctgatggacatggttgcctagtggcctggagtgttttgaaggtggctggtgcagttacaccctttatcccacaatccttggactctttcttggccttgctctctttcctcactcttacctgggctagtaactcgcacaataaattgtcactttaatccttgtctcgggctctgctttctagaagacaggggctacgaaggccctttgaaaagagttataatcatggattttggaatatttcttgtcctctgtgtatccctgaaacttagtactttttggaattggcttatgcttttaatgacctttagaccagaaaatattatatttttaaattgttttcacctgacgtttttagtgttccaaagttgtatgcttatcagaaataagcaagaactctgcaattctttgaaggccaacagcttgttacactgtttatagcataattaacaactttataacatttatgaaagtaaatggattaaatttgtaattattgtctggaaaaactgtatttttacattttatgaaacttaagcgactcaagttatgccatatttcatacataagctgaactttaattttagattcatgattagtacatcataaaagtactttctgtgctaacatttttctcttcctgacttatatatttaaaaaaaattccctttgctaatcatgatcctgtttaatattcttgggaaggttagaggtggaattcagagtgagattattggcatcgcaagaggaacagacactgaaaggtcaatttattcaatttcgtgtttgggtgcaagatctcagttactcgtcctacacatgagaaaacccttcttgcctttaagatttactggcttctggctgggtgcagtggctcacgcctgtaatcccagcactttgggaggcctaggcaggcagatcacctgaggtcaggagttcatgactagcctggccaacatggtgaaaccctgtttctactaaaaatacaaaaattagccaggtgtagaggcccacacctgtaatcccagctacttggaggctgtggcaggagaattgcttgaacccgggaagctgaggttgcagtgagctgacatcatgccaccgcactccagcctgggcgacagagtgagattccgtctcaaaaaaaagaaaagaaaaaaaagacttactggcttctttttagacacagtttgcaggaaaggaagggaacctaataacccattagaaaaataggtgttttataaataatgttaattgcagctatttcacattcagacaggtataaccaagactaagcttcactctaggaataatataaagttttaatcagaagaatagtttcaagttcttagaagaagtggtgtgtctttagatcaagtgacaactatgtgtctaaattatagcctttacccaagggtctacagactttttaggaatgaccttcacctgggtgggatgcattcccctcatcagtgtgtggaaatggacagcggatcagcatcccagagcctaagggtttgccgagttggtgatcaccatcagcagcaccttccttgggtgccccagggcaagtgagtaaccactgccatgtttggtgtaatggtgagtggaggtatcccacccacagtaggagacaggagaggccgaggcctccacacccacgtgtgcatacttcctggattcagcatgtgtctcccaaattacccaggaataggatgtaatgccttgtatctgtgacttttggaggtaccttatatatgcctgtgtgaatgaataaatggatggatatgaataaatgaatgggcctggggtttttgttttgtattgaggcaaagtctcagtctatcacctgggttggagtgcagtgtgccatcatggctcactgtagcctcgaccttctggggctcaagggatcctcctccctcagcctcctgagtagctaggagtacaggcatgctccaccttgcctggctaattaaaaaatacatatattttgttgagggggtttcactatgttgcccaggctgggggctcaaggttttctcatgggtttatttgctaattgtgtttctcctgttatgacttgttcacacccttggcctagccatcctttggagtattagtttttttcttatgaatttggatgagctcccaatatatataccagaggcttatgtgaccagaggcttgaaagaacctaacttctatttcctttaggagcaatggttcagtattcattaattgagtgtttgtagtggcttttaatagaacataattacttttaataatgaaagtccactgtatttatttcacacctcttgatttttctgttcattattttggattgtttttaaataaatcatgtatttcatacatcacttatgttcattgatgaaacattataaaatacaaaaaaagaaaaaaacattataaaatacaaaaaaccaccagcaaaactgttatccacatctcattaccctatattgttactcttaatattggatatatacccaatattattacatttacatatgttcataaaaatgcaaaaatgaaatgtactggcttctaacctgcttttctcacttaatatattgtgatgatttttctatgagaatatggatccacatcataatttttagaagttgtataatatggaaaaactacaatttatttaaagttttctaattgttagatatttaagttgttaccagttttcactaataacaataagtgaaatttattgagtgtttgctgtctcagattatgagtttaagatgtttatatgcattatttcacctaagcctcaacaaccttacggggtaggtattttgttctcccccagttttacagatgagggaactgaggcacaaaataatatacctaaagtgaaaaataagtattgcagctgggattccagtcctggaaacttgatttcacatttgtgttcccaactagaacaatgtataattagtgattctgtgctactgtctttggcaatttcctagggaaaaaaagtaatcctgaaataaagttgctgagtcagcactggatattttaaggacttttgttatgcatcgccaagttatgttccagataatttctccctcaaatagtgtaagaaaaggcgcatttccccatgtctttattaacactaggctgaatatagtattttaaaatcactattttaattgtcatttctttaattgtgagatgaaatgttacattcttatccaccttttaattcttttatgaatcactgtttatttccattgtggtgtttgtcttttactggtttctaagaactctttatacattttacatatgattgtcgaattgctgcaaataattttcctgttagtcatttgaaatttaaataggtttttctttttacgtttttattgtggaatctgacataccttggaacagtgcatagaatataaatgtacagcttatcaaatgattatgaagttaacaactgtacaaccaccagttgaagcaatggaatcttgccagtttcccagaagttccctgtgtgttccttcctgatacaatctatgcccaactttctagaagaagccacaattgtggtagccagcttcacagatggcccccagtgattctctccttctggtcttcatacccacccaggattgttccaaggtgggccagtgcgaccaatagaatatacagaaacagtgcgatgttgtattccagattgggttataaaagactgtggctcccatcttgggcttgctcactctctcatggatgaatcactctgggggaagccagttgccatgtcttgacgacactcaggcagccctgtggagaggccccggtatccaggaactgaggccctccttccaaaagcccttagagaactgaggcctgccaacaaccatgtgggtgagctgggaggcagatcctctgcctttcagatgactgcagccctggcccacagcttaactgcaggctcatgagaaatcctgggccagaatcacccacctaagctgctcctggattcctgactctcagaaactgcgtgagataacagccatgtgagctgttttaagctgctgagtttgggggtaattttttagcagagtaatagacaactaacataactattctgacttttataataataatttccttctttatcattacaattttaccaccaatatgtatgcatctctaaacaagatagtttaggtttgcatatttttacctattttatacatgtattttaaaattgggtcttatctcgatattaggcatatccctatagttgcatatagccagcgctcattttatttgcaatctagagattcattgtatgaatacaccacttacatacgtatctgttctcctgttcgtggtcatcggtgttgtcctgggtttgagactattatgaaaactgctgcagtgaatattatgggcatgtttcctggtgcacattccacaggcttctctaagttgaccttgtagtgcactcgctggctaaaggacatcggcatcttcactttttctttaacattactagataatggccaaacctcatcaaataatgccagattatactccaatctgcaggacgtgaaagttcccattattttacatccttgccaatccgtggtattattggtctttctgatttttgcccatctggtgagtatgtaagtgatatctcattgggattttaattttgcattccctgggagtcaagaggttgtgcactctttcatttattgattgactacttgaatttccttttttttttttttttttttgagagatggagtctcactctctcatccaggctggggtgcagtgatgcgatctcggctcactgcaacctctacctcctaagttcaagcgattctccgcctcagcttcccaagtagctgagattacaggtgtgtgccaccacactcagctaatttttgtattttttagtggagacatggtttcactaaatgttggcgaggctggtcacgaactcctgacctcaggtgatctgcctgccttggcctcctgaagtgctgggattacaggcatgagccactgcgtccggcctgaatttcctttttagtgacatgcttgttcaagtattttatccatttttaagaaattagttgtctttatttatttgtagcagttctttacatattctggacactagccctttgttgttatatgctatacaaatatcttctcttactctgtagtttatcttttcactctctaaagcctaatgatgtcttttgataaaagaaattattttactgtaatagggtttattaatcttttcccatatttgttttttaacatgtaggtttttttcgtagttgattttattagtctttgccattatagttcctgacttttgaaatcctgtttagaaaggcatccctactctgagattacacaaatattcacctacatgtggtggttttatttttatgttttcatttaaaaatatttaaaccattcatctgaaatttttttaaagctttggttataacattttttttccctgaatgtgatgaatacggttagcaaatttacagaataatctgacctcttcctactgtaaatgctacccgtattatgaagtgggatcctatatattggctgtatttctgagctttctcttttgttaattgctcattctgttgattctggcactttctgacacctacttgtagttgttgtgctctgcgggacacatctgatagggcctgctcctgcacgttactcttgtttttcggcattgtcctgacattttttacatttttgttttctagatgagctttaggatccctttaatattaacataattatttttggctgtgttgtagatttgtctgtgacttgttagaaattagtgttcccacttaggaatgtggcatgtcttgccatttacttttgaatctttttatgtccctcagaaaaattttgtaggtttcatttcaatagaggtctggcaaattcttattctaagtttttaaaattttttgtttctggtgtgaattggcccttttctcctatgcgttttctgatgcataggttttcaaacctccactccttcagcgataaaggctcccaaggagtggctgaaggctggggagcatcgcagctctgccccatctgtttaccgtaacaggttttgtttatagaaatcattctcttttgctaaaaaaaaaaaaaatttcctgattggttgttactgaggtttgaaaccctgtttttgtgtacgcttttttttttgagacggagtcttgctctgtcacccaggctggagtgcagtggcacgatctccgctcactgcaagctctgcctcccgggttcatgccattctcctgcctcagcctcccaagtagctgggactacaggcgcccaccaccatgcctggctaatttttttgtatttttttagtagagacagggtttcaccgtgttaaccaggatggtctcgatctcctgaccttgtgatccgcccacctcgacctcccaaagtgttgggattacaggcgtgagccaccgtgcccggcctgtgtacacttctttttaatgaatgatctttactgatatcttttgttggttttaattacttttttagtgattcatcttggatcttccaggtattcattcctttattattattattattttttttttgagagagagtctcgctctgtcgcccaggctagagtgaagtggcatgatctcagctcactgcaaccctgcctcctgggttcaagtgattctcctgcctctgcctcccgagtagctgggattacaggtgcatgtcaccacgcctggctaatttttgtagttttagtagagatggggtttcaccatgttggccaggctggtcttgaactcctgacctcaggtgatctgcctgccctggcttccaaaagtgctgggattacaggagtgagccaccgcgcctggcctcattcatttatttattgaaaaaatatttattcagtgcccacccactgtgtaccagacacatttctaggtgcttggaatatatctatgagcaaaatccatgtatatcatatggtaagctcaaaatgagtatattatacggtaactactttggagaaaaagaaaatggatcaagggttctagaggtgggatatgggatccaggcagaattttattttattttactttattttatttattgattgattgagacggagtcttgctctgtcaccaggctggagtgcagtggtgcgatcttggctcactgcaacctccacctcccgggttcaagggattctcctgcctcagcctccggagtagctgggactacaggtgcgcaccaccacgcccagctaatttttgtatttttagtagagacggggtttcaccatgttggctaggatggtctcgatctcctgacctcgtgatctgcttgcctcagcctcccaaagtgctgggattacaggcttgagccaccgtgcccagcccaggcacaattttaaataccgtggtcaccataggtctcattgagagggggacatttaaacgaagacttggaggtaaggacgccggctatgtagatatctgctggaaaagcatgcttggcagaggggaaagcctgtgcaaaggccttagaaacacgctggaggtgttcgaggatcatggaggggtgtggctggagtgcagtgagtgagggagtcaaggttggttagggagggatagagtaggggacagatgtttgtatggggccttagtgtaaagactgacactgagtgaagagaggagccattgcagagttctggaatattgtagggacaagatgggcttacttttttttttcttttgagatggagtctcgctctgttgccaggctggagtgcagtggcacgatctcagctcactgcaacctctgccttctgggttcaagcgattctcgtgcctcagcctcccaagtagctgggattacaggcaggtgccaccacacccacttaatatttgtatttttagtagagatggggtttcaccatctggttggccaccatcatgttggccaggatggtcttgatctcctgacctcgtgatccgcttgcttcagcctcccaaagggctcggattacaggcgtgagccactgctgggcttacatttttaaaagatcattctggttgctcctttgagaatagattttagaggggccggggtagaagcagggagactgattagaggcgattgtaacgctcctcacctaggatcttactgtgcattgagcaattggtaaggcttatggaatgaatgtttttacctacatcgggcattttagcgtgcattaagaaactacacatttaaaaaatacatatttttcttgagaaagtgatgggacagaaaagtgagagcaggggaattgcctttggaacaggccattttggtcaagccttgtcctggataaagaagatggggaatgaaggctgacctgccgtggaggggaggaatgggcaggcatgccctgcctcatctcacggagtgagggcagaatctggggagcgcgttcttggatgtcccaccaactttggagaggaccggaggctggggatagacaaggactactatgatgaaggaagctcgtaagttcgtgtttgcttctaaatggttgctgtggctttctggctttaaactggtttatattttctgcaacctcacttcttcctaactatttagtagaccagaacttctcggtaatttattgctcaatagtgggagaaaggaagaacttcgttttcaggttaagacttcatatgtcaaatccagttttattggtgtgataaatgctggtttctgttaaatttaccaggttggtcagtactggttcctgatacaagaactgtatttacccttttaagaagatgatttaaacttctggagaaaggaagagggcaaagatctttaaagagtatgctatttttatgacgcctccctaattattcagaaatatgaataattcaggaatttaactgtagaataagtataaattacccggttactgccttgaaagagtttacaatcaccttgaagagaatcctgccctcacccccaccagtttcacaaagcctattttaaattatacccttggaaaaattaaaccaaaacactgcgcaaatatgtttggtgtggagttcatttctttgatttagtcctttcactttgggcccacacacttttgccatcctttagggagcatgcccagtgctagattcgaagcgaatatattaatgtatgtgttcacccatcaatgccttgtgctgagggaaaaacagaagagagtgtcatggaaggcttaaggattcttttttttttttgctgatacaaagtactttttgttattcaatgcttgtgccatcatcagacaacttcatccagaatgcacagcaactctgtaatatagctctgcctggtgcaaaatacctcattttgtatagaaatgcaggattgcttcatgtagatacaatagaaagaatctttgctttattcatgtatgaataaaacgtctttgttcatggaagagaaaagtgcctcttattgtttggaagctgtgtgaattttaaattaagctgatggcccactatattacatatttcgggggaaaaattagctttgcttatataagtttggaatctaatgtctaacctagtggcctaaataatttttgctttgcagtttgtttattatgtaaagacattgtgtttgccacagacattgcctgtcaatgaattgctttagcaaaattctatagtcctaattttaaaaagttgttatttattcccttgtcccacataagatttgaagcagcttgcaaaaaattaaaaatacaatgtaaataacagtcataaatcatgatcagagaaaatataaatattttatggaaaagtcaaagcttgtagaggcatgtgtgagtgtatttatgtgtcaatatacatgtaaaagggtccatgaagcagctatgtggatcctcagatttgatgttgagcttcctggcagccaaagtggaaaaaggaaggcaatcagttaatcctttctctgggtttgcaaaggactgcttagagcatatccaccgccaagcaggggtatggcattcgggctttcccaaaagaaagctggccactcagatgttctcactcataggtgggaattgaacaatgagaacacttggacacagggtggggaacatcacacaccagggtctgttgtggggtggggagaggggggcgggatagcattaggagatatacctaatgtaaatgacaagttaatggttgcagcacaccaacatggcacatgtatacatatgtaacaaagctgcacgttgtgcacatgtaccctagaacttaaagtataataataataaaaaaaagaaagttggccaatcggaagaacggattaaataaaggaatgctgtaggtcctgggacccccatgatggtgccttaggcttttccctttgcagaaagtaccacctctggcaagtgacctgcaggactacaggcagaagtagggctggcagagtgcctggtgtgcagtcacagaaccctccagctccagatgtaaacttttggctttcttcaaagtgttcgctggttcttaacaaaatgagaaaaaataagaacaaataaggaaaaaaagtaaatttccttcaaatctgaatttacgtgacgtcagatattatgttcttcctataattttagtattaaaagttcctttttaaaatgaaaacagcagcaatagttcaaaaggttgtgtcctttcctggggaaatgaaaaaagttgaaaacactttgtatacggtaataataataatcactattactactactacgggtatttactgcttatgaaatctaaaagtctagaaactcctatttctcttgggctctacagcatctcagtcagctgctttgtctccaggatcacatttccaattttctctcttttctctctcccagtgtaccgcgcacctgctggttccctcacccagtacatcttggctcccaggaagccacacccttgacatttaccatgcttcctgggcatttcctgctaccatccccaccctggacagggctaggatggtatcaggacttagtgctgcacaagctttcaggataccgggtaagaggggagtttgacacttggaacaatactggacctaaaaggagccaggccttggatggacagtcactctccatgagtttttgcaccatgtcagcactataaactcactgcagtgggagtttcgcattgacaagggtcttcagacctagctcacctcagaaggtaaggggggccttgacaggtcctctcaagggggataaatgccacctgctatttaaggagacttgaccccatccctgcttctatccattaatgggtgactttttaattcttctggaactcttattgccaaggtcttggtgggactgagggtgagatcgcttttctgtaacacagatgcattgccattttgctccttgatagtgtaagatgtttaagtcaattaagacaaaaatgtgcttaatactcttttcatttgccttaacaactccacgtttatttaatatcagtttaattcttggctgctgcaaggtctgggtagttttcatttcgaaactactcctagggtgagaagtctcttaagtgcctgtggtattcccaaagaatttgcttttgtgcggcagtcacagcctggaagcgcgctgctttctttgctcctggtgtcagaaaagctactcctggttctcagattgggctttcctgcacattagaattggaaaggtcctctttgtgtctgcccctgtaagggagccaaacaaaaggcgccagagtggtggtagggcagcatcatcgctccctaacctccaccctcctccttctctcttccttcctccccgtccctgcctccctggcctccctactcctccatcccctccaagactctcaatgtagtcagcgctctgttttccccacctttgcctggctgccacctccctccctccctctccctatcagcttcctccggatgaggtgctattctgcatggaccccttagagtactcattaactagatgaataagctgccagcaatattgttcctgcttcccacattttaaaaaggttatctctttctttttccttctaaactttagagccatttgaaaataatcttttggaaatatatttacataggtctcatgacaaatccacatactccttttcagacaggtttcaacgactgcataatgagatggtctgggtcagctttgcacaaaagttgtacttttcctgctgtgaatctgtatttttccgctgtgtgtatttgcaatgactttcccgccctaccttccactagtgatgcattaatcacagcatggagctgagaggcgtgggattggaagggtctttgagaagttttttaatcgagctagaacgaggtcaaggttttgagcatttaacttgtgggatgttaattacttggctatgaaaaggaaatttgttttctgaaagttcaactgtagctacagaataaaggccatggaaagataaggcatggtgtcaagaggtttcatgatcttattccacctccttttcaggccccaactccactcaaaccctccactgttgagccacactggatgtgtcaccctctgtccctagacgtgctggacatctgcatcctgtggtgcctcggctcaggcttctctttcatctgggaaaacccttgaccctctcctagacttcccaaatgctgcttcaaggcatcatccctgccctccttcctttagaaagtcttttctaccactgagaacacttccctcatgctccaccgcagactgtacttcatgctgctttgctctttgtggttgatgcatctgtctctcccactaaatcatgaccctccattcatttctacttcccactctacccagggcatggtaggtgctcaataaatctttgctgaatggaattttttcatctaacccaagagcaacctgagcagaaaatcataaatgaataaggatcgtaaatggatgatcatcataaatgactaatcatcataaatgaatgcttatgggatatacacaaattgcagaacactgatagctatggcatagctcttatcctagagtgagtttcaattcactttaggttaggacatagaaaagacaaggagaaacaactagtccatgaggattttttccatgctttgttctttccatctgtgctgttcagtagctagtttcactgagcttccctgtagtggatgggtagagattgtgtattataagtacttgctcatcagtggctcaagggcaaaaatctcagtgcctagagtttggcataatattatgtgaaaaataattttttgcaatataatgagatgtgacactccccactttccagaacaaggacttgtctcctttggatttccagacctaaagaagaacatctcccttgaaaaacttttcccactggcaattcagccctctgttttccaaacccacttagaagctaagttgcactggaaatacacaatgaaatgtttatgggaaaaaggggcatcatatccacaatttgttctcaaaatgatttagtggagggagagagagagagagggtggaaagggtgggttggagggagcaaaagagagacagagaaaattgataaaataaatgagataaaattgagggaatctggcgaagtctattggagcattctttgtagcattggggaattctttgtcatatgcttgcaacttctctgtaaaccagacattatttcaaaataagtttttttgaaaagcaaaagcaaattctttgaattcttacccagtttaaaaggatgatatgattgcaaaaaagttgtgtttctctatctataggcataaatggtagtgcttggcagtttaggatccattcacacagaaactgcatttgaggcaggtgtttgtgagcaccttttgaccccttgacatttaagcaaaggagaagtgggttcctcttattcgcagctgtcataggtcagacttctgcttgttgggcgtgtcaggctgggaaattcccctcaccgccaagatgtccatgtcctaatccctaggacctgtgagtgataacttatatgagaaggcaatgcgaggatggaagcaagagattggagtgatgtgaaggagagatcagggtccaaggaatgcacatgacctctagaagctagaaaaggcaaggacacggatcctctctcctagagcctccagaaggaaccaaccctgccagccccttgattttagccctggaagactgattttagacttctgacctctagagctgtgagaaaataagtctgtattgttttgctactaagtttttggtaattttttatagcagccagaggaagcaaatctactgggtgagtggattctatgcccgagttcataagtgagagtgaggccaaggcatgagttctggattattgtcattagcatttcaaagaattgtcctctggctcaaatcagcggtgttcacactttgcttaattgcctgtgtcttattttgttctccagctttgatcacatgtatgacaaatggaatcggaatgaattgcagaactagcaggtcgagtgcttgacatcacctcacagagatgtcatggatgctttgggaagtgctttgcttgacagtgcctggatttatgtagcaagatattttgtcctggggtaaagggagcccatgcaggtggggggggaggggaagggaatgggagctgatgcctaggcaggtttctcaaacctgtgtgaattaaggacccctctccataagggacttttttggtgtattgacttaaatttagttttattatattgctacttaaatctgtataaacataaaactaagtgttaatttatgcttatagctttaagacaactataaactccaaacatttcaaattaaatgcaaataaaattacaaacctaataaaattcaaattaacatcactgagttaatgtcatggataacgttttgctgattttaaattgatgttctcaatgtgttttcacacacactcgtgaagttatggaacattatctttgtttctgctggacttgtttaattcactgtaaaaatatcgttatgttgaaagaaacatatacatcacagtaataaattgatttatctagaacagttttcagactctaatgcaaatattcagttggtttcattcctggaaaaataaaaaacagaccaagataaatcatagtatttagtgatgtacacttaggggattaaagtcagtgtagtaataggctatgagaggaggggggagggatacatggggggcttctggattactggcaaggctcaatttcatgatgagcatgcctttcttgagtctctctttttctgtgaacataaaacataagtgtactgactgttggatttttataaagtgaacactaatgttaccccatcaaggacaagaactaggacattgctagcatcccagaagctcccatgtacccttttatagttacatactcctctttcccagcaaaataacgactatagtatgttttgtggcaatcacttattgcttttatctatagttttacaacctaagtaggtgtattaggccattcttgcattgctataaagaaatacctgagactgggtaatttataagaaaagagatttaattggctcatggttctgcaggctgtacaggaagcatggtgctggcatttgcttgggttctagggaggcttcgggaagataacaatcacagtggaaggcgaaggagcagcaggcacgtcacatggcaaagcagaacaagggtgggggaaggtgccatacacttttaaatgaccagatctcatgaaaactcactatgaccaagacagcaccaagtcatgaggggtgtgcctcatgatcaaacacctcccaccaggccccatttgcagcattggggattacaattgaacatgagatttgggtggggacaaatatccaaactgtatcaggaggcattcctaaatactgtgaattgaattttgcctatttttgaacttctaaaattagggccatatcgtatcttttgtgtttgactctttcagtcaacatttttttttttaaagatacatccatgttgttctgtatgactgtagttcatttttatggcagtatagaataccattgtataactataccatacttttttgagctattttcctgttggtagacttctggggtcttttcagtttttggctattacaaatattgctgctatgaacatacttatacatgtctcctagaagacttgtatctaaaaatagaattgatgtgtcatctggtgttcactgctagatgatgacacattgttttccatgtgactttctttcttttctttttcttttcttttctttttttttttttttttgagatggagtctggctctgtcgcccagtctggagtgcagtggcataatctctgctcactgcaaactccatctcccaggttcaagcagttcttctgtctcagccacccgagtagctgggattacaggcctccactaccatgcctggctaatttttgtattttttagtagagatgggatttcaccatgttggccaggctggtcttgaactcctgacctcaggtaatccacctgcctcaccctcccaaagtgctggaattacaggcgtgagccaccatgcctggccatgagtttcattttaatttgtgtttccctcattttgattgaggttgagaaccttttcgtatatttattggtcatttggatttcccttgttgtgaaaggtctgcccaactattttgtccatttttctctttttcagtcttcttattgatttgtagaatatatattcattctggatataagcccttgtcggttttatgtcaaaattatttattttgcagatctctctctcttcttttaaaaataattttaacctttaatttagattcagggggtacatgtgcaggttttttatatgtgtatattgcatgacgctgaggtttggggtacagttaatcatgtcacccaggtactgagcatattactcaaaagtcagtttttcacccctcacctccagttctccctcccccttctagtagtccccattgtctattgttgccatctttgtgtccacgagtacccagtgtttagctcccacttataagtgagaacatgcagtatttggttttctgttcctgtgttaacttgcttaagataatggcctctagctgcatctgtgttgctgcaaaggacattatttcattctttttatggctgcatagtattccatggtgtgcaagtaccacattttctttatccagtccactgtcgatgtgaacctatctttgctattgtgaatagtgctacgaatgaacatacatgtgcatgtgtccttttggtagaatgatttattttcctttgggtatatgcccagtaatgggattgctgggttgaatggtagtttcgttttaagttctttgagaaatctccaaactgctttccacagcagtcgaactaatttgcattcccactaacagtgcataagtgttctcttttctccacagcctcaccattatctgttgttttttgactttttaataatagtctttctgactggtgtgagatggtatctcattgtggttttgatttgcatttctctgatgattagagatgtggagcattttttttgcatgtttttggttgcttgtatgtcttcttttgaaaagtgtttattcatttattttgctcatttttcaatggggttatttgttttttgcttgtgcaattgtttaagttccttgtaaattctggatattagacctttgttggatgcatagtttgcaaatattttctcccattctgtggagtgtctgttgactctgttgatagtttcttttgctgtgcagaagctctttagtttaattaggtcccactgctcaagtttttgtttttgttgccactgcttttgaggacttagtcataaattctttcctaaggctgatgtccagaatggtgtttcctgggttttcttctagaattcttatagtttgaggttttatatttaaatctttaatccatcttgagttaatttttgtatatggtggaaggtggtggtccagtttaattcttctgcatgtggctagccagctatccctgtaggtgtgcagctttatttctgggttgtctgttctgttccattggtctacatacctgtttttgtaccagcaccatgatgttttagttactgtagccttatagtactgtttgaagtcgggtaatatgatgcctccagctttgttctttttgctggtgattgctttggctatttgggcactttttagattccatatgaactttagaatagttttctctagatctgtgaaaaatgatgttgctagtttgataaggatggtgttgaatctttagattgctttgggcagtttggacatttgaacgatattgattcttccaatccatgagcatggaatgtttttccatttgtttgtatcatctatgatttctttcagcagcgttttgtacttctcctcgtagacatatttcacttccttggttagatgcattcgtaggtaattttttgtgtggctgttgtaaacaggattgcattcttgatttggctctcagcttgaatgttattggagtatagaaatgctactgatttttgcgcattgattttgtattctgaaactttactgaagttgcttatcagttctaggagccttttggtggagtctctagggttttctaggtatagaatcatgtcatcagtgaagagaaatactttcacttcttttcctatttggattccttttatttctttctcttgtctaattgctctggctaggacttcctcttccactctcttactggtatctgttggtcagtggaagttcttaattttagtgtagtcaagtttatccttcttttccgtatatggtaagtatctatacgtgtaagtgtttatacgtagctgttttagacatctttttcaatcccagattatgaagctactctttatttcatcttctaaagctttatagttttgtttttcacatttagtattgtaagtcaagaactgtggagtgtctgaaattttgccttacttgcaagctaacaagttagcctgccttagtgtcacgaatgttgccagaagacacaagactccgggtcagagggtcggagacaaatgactttgccagagtatcggcatcttcttgtgccagttcccagagcccaaattcctacagagcaaatgtgtagagggtcaggtgacttgtacacctggagtgaactgtgttagaggtgaggagccctgaggctagggaacccaaatcttttataatgggctgtaagcttgcctgacctttgcccagagggagaaattgtctttatatactggacagtaaacaagtctgtcattttccttggggagagacactatatcttctaagactgtttgccatacaaatatcctttgaagagatagcaaagaacaaaaaaaagcagagtgtctgccttcaagacttgcagaaacatgagggatttagggaaaactgtctcccctaaggtgtaatccacctgttagtaatttgcgtgtggtgagaggtaatttccgtcattttctatgctgaaactcaattatcccagcatcatgccttggaaaagtgggagaaagctgtcttccaagagataggtgctggtgaattagactgaggttgctgcagtggaggtgaggagtgggtacagactgagctacatgcttcagagatgacagagctccatgggctgttgggttgttgaggaaggggctgaaggaaggacaagtgtcaggagtaagagtcttcttcgttgagtcttaaaatgtattgtgtccctagagaggaaaaacaatcatttaaaataggcctttactgtattgaatactggaaatttgctaagatggtagattttagatgctcttacctctcccacccacccccacaacacagataactatgtgagatgacagatatgttaattggcttgagtgtagtaatcatttcactatctatatgtatattaaaacattatgttgtgtatcttaaacatatgcaataaaaattaagcaaaaaataaaaaggcccgtatttctcttaacctgttaaatactcggtataaatttgaatttagaatctgaagtggatcatgcacctggaattcctgcgtgtccagctggcctctttctgaggtgtgtttcctcttactgatatttattcttccctttccagtctgaaaagcagtctccatggcagaataattggtaaccaaatgtagatctatctgcaatggaaagtgacattttgtgagcaaaacctcaactttttaacaaaagaaaacaaaccgtagagcaaaggagattttctttcattagccagggtccagttaggatacaggaaccgtgctaagtatttcacatggaagggatttcatacagggatctggctatacagggtctgaaagtttgaaaaaattaaaaatggacactacctttaggtgctgggtgacaaaagggaagaggtggcaatataaaatctaggtgctcagagaaggagctaccttggatggtgctgaggatggggaggggagagctgggaatggaatggcccaggagataccacagcgctcctgctttacccgctgctggaaggatgaccgtcaaggctaaaagcaggaacacagtcctttcttcccagctccttctttccactgtcacaacataaccagaagccagcagcaaggaagcctgagaaatgtagattgcagagtagaatcactgagtggaggttggggctgagagacaataggcaaataaccagcacagagtctaagcagcaaaccgttcagattagctcctcctacaacaatgtgaaaattggaatgctcattttgttgctacttctaggaactgtggcccgtgggtcagttgggaattaatggcaaataaaggagattctggggcagtgtttgcttatgtgttgtgtctgattaatttccaaaatcaagctgaattaattttggatttatatgcattcatttttgaggtcaaggctagaggtcataatatctgaggtctcattctcgccacttttcctattgctggaatagtggtgctatgtcggggagaggacacagagaggaacaggcactgagaaagggagggaaatagtgggttcagaattgggacatccaggaggcagctggaaacgtgagtctggaactcttgggtgagatttggggctaaagataacaatttgggtgcttgatggtaagcacatcctttgagagtatatgcagtttcccaggagagaatgtgggagaagagttgagggaagggttgaaaaccttggaggacaccaacattttcaaagttagaggagccagcagaggcgagctcatcctaatggagatcacttcgttcaagcagattatttgcttgaaactttcatctttggtattatttgcactgtagtggaatgaacaaccataatgtgagtttaaaacccagataccaaaatattgtttgtttatagtctccctcaaactccatcttccgtaagtgctggtgtggggattatgtacctcttcacttctcttctctgcactgttgataaaggaagaggcaggttttgctgaccacattttggcaaatctgttggctctttcttgggcattcccatgctcatggtcacaatactgttactacgttaatttaactctagaattgagtttaagccactaatcacaatttctttttcttgctttgtcattatagctgctttttgaaaagcaaaattactaaatttcttaagtcaataatttcaggttgataaagaagaggcaaaatatatgcaggctttaaaacatgctctgagaccacagaagggtctttttctgatccaaatatcctattaaaactgtgtgactataggaaaaagtctgtgtaggctagagcaagttcagttgaaaacctatttttaaaaacacttaaataattacctttcatcctaaatcatagacatggtcagcattgtaagaaaagctgatacacccaaatctgaatatatatgacaaatagatcattaacaccctttcattttaccaaagtattctttgatagtgcctttaaataagccagtttctaaagtaaatttaaaatgtcttcaattataaaaaatagatttacatgtgatgtttcaaggacatatcttgtgaaggaagtacagttgtaaagtgttgagcaaagtcatgaaagttttcacaagaaggaaaagaataacatttatttctaccttttcttttttcttatcagcatctcaaaatagaccaacagtatattccattgttactatttatttgctgcaatacaaatgacatctcatttgattttagccctttaaccttgagctaaaatgaccctgtggaaacaaatgagcactgtagagacacctgcccctcagaagagtttggaagggcagagttctgtgggagagtttgcctaggaagtggtgcggggtgggctgcccgggaagggtgtgtggagtagagaccaagaaggggctgaacgccatctcccaggaagcttcccaagactgacttttcttatatgtggcctccaggcagaggtggggaaatccccaagccttcccagagggcagtgaggctttctcaccttaacttttgagttaggaattagttcacattagcagtttttggctccctgaggctgagattggggagcttttctgaaatcatggaaatttctggcccttatctctagatgaagatcccaccttaattttatgtatccaacatagcctaaactattgttctttttttctgtctctgtcttcctttccccctgcctccctccttctctctcttctttctttctttccttcttctcatttcccagtggtctggtctccaaaaacaaatgaatgtgtgaaatcagtgaggattcttctccctggaaacaatgtgttgttggcaaaagcaacaactgcctctgcaaacatcaaaatcctccaaaagagtgaatggggaagatcatatttggtgttcagcaatctaaaaaaaaaaaaaaaaaaaacagacagcaaaaacccagaggaagtgaagaaagttagtaggaactggtaatactatacagatgatttcttctccacctgtttggaagttttgcttaagtctggcttttcttgcagtattaggaagtgaatatggttggtgtaagagaaggtgacagtggatactatacgcagggagctctgtggagccttgcagccctgcaagtttttatttgcaaggtgttggttgaatcagcctttcctcctaaaagtttcagcacatacaagttgctgacttattggctgttttcttcttttaacccaaattctgtattcttagttgtgttgtcatgaaggatgcatcttctcattttcaaagtgaaatcaaatggatccatgcctttcacatgtaactttctgttcaactgcttaaaattatttttattgatccataacatttgtacatgtttatggaatacatgtaatattttgctacatgcatactgtaatggtcaagccagggtatttagggtatctatcgcctttgtatttatcatttccatgtgttgggaacatttcaggtcattctcttctagctattttgaaacatacaatacattgttgttaattatagtcaccctactctgttatcgaacattaaaacttattctatctaactgtatgtttgcactcattagctaacctttcttcatcccctcaccccgcaacacacccttcccagcatctagtaactgtcattctgttctgcctccatgagatcagttgttttagctcccaaatatgagtgagaatatatgatgtttttctttgtgcctgacttattttacttgacataatgacctccatttccaaccatgttgctgcaaataacaggattttattcttttttatggttgaatagtattccattgtgtatatattccacactttctttatccatttatttgttgatgaacacatgattctgtgtctttgccattgttaatggtgttgcagtaaacatgggagtgcatgtatctctttgatatactgatttcttttcctttgaataaataccaaatagtgggattgttggattgtatggtagttctatttttagttttttgagaaatctccatactgttttccataatggctgtattaatttacattcccaccagcagtgtatgagagttctctttttttcatgttattagcgtctgttattttttgtctttttgttgatagccattcgaatttgataagatatctctattgtgtttttgatttgcatttccctgatgattagtgatggtgagcattttttcatatatcttttagccacttgtatatcttcttttgagaaatgtctattcaatatgctattttaaatgagattctttgtgcgtgtgtgtgtgtgtgtgtgtgtgtgtgttttgctgtggagttgagtttctttgtaaattctggatattagtttcttgttagatgaatagtttgtgaatatgttctcccattcaacaggttgcctcttcattctgttgattgtttcctttgatgtgcaaaaactttttactttaatatagttctatttgtttaattctgtttttcttacccatgcttctgagatcttagccataaaatgtttgcctagaacaatgccctggagtgtttcccctgagttttcttctggtagttcatagtttggggtcttatgtttaagtcttaaatctattttgagttgattttgggatatggtgagagatagggatccaatttcattcttctgcatatggataccgagttttccgagcatcatttattgaagagggtgtcctttccccaatgtatgttctgggcatctctgtaaaaaatcagttggctgtacatatgtggatttatttctgggttctctattcgtgttctgttggtctgtgtgactatttatatgctgataccgtgatgctttgattactatagttctgtaatttttttgacatcaggtagtgtgatgcttctagctttgttatttttgctcaggattgcattggctatttgggctcttttttggttccatatgaattttatgactgatgtttctatttctataaaaaatgtcattggtattttaatagggattgcactgaatatgtagattgctttaggtagtatgttcattttaacagtactaattcttcctggctattattaaaaagtcaaaaaaatcacagatgctggtgaggttgaggagaaaaaggaacacttatatactgttggtggaattagttcaatcattgtggaaagcagtgtggtgattcctcagagagctaaaaatagagctgccatttggcccagcaatcccattactggggtatatccagataaacataaattgttctatcataaagacacatgcacacatatgttcaatgcaacactatttgcaatagcaaaggcatggaatcaacctaaatgcccatcagtgctagattgaataaagaaaatgtggtacatacataccacggaatacaatgcagccttaaaaaagagtgagatcatgtcatttgcaggagcataaatggagctggaggccattatcgttaacaaagtaacacaggaacaaaaaaccaaaaactgcatgttcccactcatgagtgggagctaaatgatgagaacacatggactcttagaggggaacagcagacactgggccttccagagggtggagggttgaaggaaggagaggatcaggaaaaataactaatgggtactaggcttaatacttgggtgatgaaataatctgtacaaaaaacccctgtgacaggagtttgtcatataacaaacctgcacatgtacccctgaacttaaaaaaaaccaaaccatattaattcttctaactcatgatcataggatgtctttccatttgcttgtgtcctcttcaatttctttcatcaatgttttgtaattttccttgtagagatctttcacctccttggttaaatgtattcctaggtatttctttggtaactattgtaaatgggattgccttcttgatttctttttcagctatttattataggcgtaaagaaatgctactgatttttgcaggttgattttgtagcctgaaactgtactgaatttatcagatcttagagttttttggtgtagtctttaggtttttctaaatataagattttgtcatctgtaaagagaaacagtttgacttcctcttttccaatttggatgtagctattggatgaaatgttctgtaaatgtctgttaggttcatttggtctaaagtgtagtttaaatccaatgtttctttgttaattttttgcctagataatctgtctaatgttgatagtgggataaagtcttccactattattgtattggagtctaactctccctttagatataataatatttgctttatatatctgggtgcttcggttttggtgcacatacatttagatttattatttcattttctttattgatccccttatcattatataatgatgttctttgtttccttttactgtttttgacttaaagtctgttttatctgacataaatatagccattcctgctcacttttggtttctgtttgtgcagaatacctttttccatccctttacttttagtttatatgtgtctttacaggtgaaatgagtttcttatgggtggcatatagttggctaatgttttttaattcagccagtctatattttttaagtggaatatttactctgtttactttcaaggttattattgatatgcgaggacttattgtcataattttgttaattgtcatttggttttgtggttctttgttcctttctttctctcttagtgtttatcattgccacttgcaggtcttctgtagtggtaacatttgaatctctttttttttcctcatttgggtgtttgctctaccagtgagttttattcttttgtgtgttttcatgatggtagatatcatactctcacttccagatttagggctccgttaagcatttcttacagagctggactagtggtgatgaattatcttgtttttgcttgtctggaaaagactttatttctccttattttatgaaggataactttgctaggtatagtatttttggctgtcagcttttttctctttcagcactttgaacataaacctcaagcttattctctccttgcttgtaatctttctgcttagaaatctgctattagtctgatggggggcagttcccttatgtgactagatgcttttctcttgatgtttttagaaatctctgtctatctttggcttttgacagtatgctacagagaagacctttttaggttatatccatatctatttggggatctctgagattcctgtatctggatgtcttaatctcttgctagacttgggaagttttcagctgttattttgttgaatacgttttctatgcctttgtctttctcttcattttctggatcatccagaatttgaatatttggtcactttatggcatcccatatgtcatgtaggctttgttgattcttattcattcctttttcctttttcttttttgtctgattgggttatttcaaaacatttgtctttaagttctggaattcgtatgcttaatctagtctattgttgaacctcttgaataaattttttatttcatatattgaattcttcagttccaggatttctgttttgttctttttttcatatctgtctctttagtgaatttctcattcacattctgaattgtttttctggtatctttgtattgtttatctgtgtgctgttgtgtcttactgagcttccttaataacattattttgatttttttctgatatttaaaaaatttctatttcattggaatctgttgctagaaaactattgtgttcctttggaggtgtcatatttccttgctctttcatgtttcttgtgtttttatgttgatatctgcacatctgatgtaacagtcacttcttccatttttttggattggctttagagggggaagactttttcctgaagatgtgtttatgttgatggttaggtatagtgccttagctttgattctgggtgcaggcattggtgtagtctcggtatgatttatttgattgtgaacagcatggtgtctgtgattgtctcagtggcctggctgtggttgttagtggatgctgtggtgatgctttgctggggatgcctttgctggccccagcaggtgggccagtcctttgtgcccagtggtggcagtggtgggccaattatgccagccattaggctgctgggcagtgtacatgggcaccagtgttagcagatccaggcaggctgattcttgggcctccaggtggcttgctcagattccagcagtggcagcagtgggctggatgagtgggcaggtcctggggcccctgggcagtgtgtgtggcatgggagatagtagtaccagtggcaggacaacccttaggcttccaggcagttagtgatgttagtgatggttgtgatgggctgggtggcccctcctcaggtccccaggagtacaaagataccagtggtggtggactgggtagagtgatccgcaggcccctgggtgatgtactcaggcactcaagtcaggggtggttgtgccaggctaggtggtcctgtccttaaccttctgatggtatgcacgagtgcaggctgtggtgggacaatctgtggtggtgggtggggagagcttgtccccaaggtgcagataagtgcgcagcatccctgctgctcagtgggtggggcgggggtggggtggctgttagtgggagtgaccctaggcatttgggcagctttcaggctcttgggagtgtacacattagtccttagcagcagcagtaacagcaatgatgacagtgggcagggagcctgtcctcagagtgcatgctagtgcatagtggccacgcaggcaaacagctgtcaggctttggggaacatgcacattggctccccttgtttcagcagcacagcagcagcttccctggtgtgccacaccacccattccctgtggtgtgggactcttgagtgggctagagtgctagggaccctgctgcactgctgggtccagccagcatcatgctactgcagtcctccagtgtagggggttgttagtggtgcttcagggatgtcgagatgcaggggctatggcatcccagggcaggatgccctggttgaggttaggcactcagaatggtgctgttctgcagttgcttaggtatcaggggagtgtgtagagcactgttagttctctttctggagcaaggcctttgcacaatctctaggcagctccctgtgctagtctcagggcccaggaggatagagaggctcttccatggctaagatgacaggagtcaatggtgggaatgtggacttcttgggatctcttaccctttccctgcaccgggaacctctccaggcttctagctgatgccagctgaactggccgccttgctttcccttactttctgtgcctcaggtgtttcctgtcacttctctgctaaattccagtgttttcttttagatgttctatttgaaatgtgattatctatttcctattttggttcttttttggggaggtggtgagtgccagatacctctagtcagtcattttgaacctccccggcccctcctcaggtcaactgtttttttttttaataagaggatttttgccccttaattttctgggattatgtcccatataattcttgtaaggcaatctagacaaaattttcagtcattaattttgtgctttttttcttatgttgaaactactaaaacaacaggttggcttttcttcagttaatcatcatgattcatcttttccattatttgttaatttgccatctagcaattgtatgatgacaaattcttttttaccttttaaactttactgaaggcacctaggccaggagatcacatggttagagacattacatttatttccttccaacacaaagaaagacagcaaatagtaacaaccccccacccacacctatacccaagcaaaacaatattatcatgtttgctatcctacaagatccaatttcccttgacttttattggagaaaagtgtcagtactagaaattcaaacagaatccttaacatgcccacagattatttcagggatccttcagttcattttcttgagcagtagctggtcagagggcctactactttgtgtgcaccattctagtgctgaggataccataatgagtaatattcatgagtaagaccgtaatgaatataagaccctgtccccaggcatctcataggccactgtgggaagcacatcaataaatttcagcgcagaatggttaagtgctgtgtaagcttttaatgtattcaggagatctgcagaaggggcacccaactaggtctgaggagtcctaatgacctttgaaggctgtgtaggagttagctatatggaaaaacttccaggcaatgggaacagcatataaaacggcagaaaggaacagggtgattctgagtgaccaagagtttaggaatggagaagtgtgaggtgtttatgaggagggcaatgaatgaggctggagagaggtaagtggcaggcagatcgtggaaggatggtacactgtgttgagtatggattttattttaaaggtgatggaatcactgaatcactttggggaatagcattattcaacgggtgttttggataactcattggcagttgtatggaggaagaatttgaggagtcagttaggaggctgttagagcagttcagagatgagatgacagtagcctggactgaggatatgttcatgggaatggagaaaataaaatggaatcaagagatgtttgggatgtagagtggataacacttggggtggtgtgtgtgtgtctgagagagagagagacagaatgagagagagagagagagatgagagagatggaagacatatatgttagggaactctatgcagcatttgtggctctgaaggtttttatttggaaggtgttgattgaatctgtctttttttctgaaaacttcagcatgtacaagttgctgacttattggctgtttttaaaaacatctgaattctatatatacttctgagagtccattacatttttcttaggtctaggacagcttttagtttccagactatcaactgtgtgggtggtgattccactaattgagagaagggaagataggcaaataagtagaatgatgagtttgtaaattgtgtttgaggtatctttggaatatctaaagaaaatttccaaaaggcaattggatgtgaaaaaattgaagtttgagaagtttgggttggagttatggattttcaagtcagtagcaaaataggtgattaacgagttcatggtaatagacaaaatcatcccaggagattatttagggcaaacatgatagaaggccaaggttgtaacactaattgagaaaaagaaattataaaggtaattgagaagtgtctaaggaggaaggggatgatatttagactgcagaggccaagggaaggggtggtttcaaggtgggagtggacagtagatttagaatgtctcagatcatctaagctaggagcctgaatttatcctgggtatgaaggaattggatggtcattaatgacagcagttttaatggagccagattgtaaggtgtatcagttaggaatgagtttggctgcaagttaaagaaaacctaaccatagtggcttacagatctaggcttatttttctcatctagcatgaagtccagagatgggaggctgctggtgtttgttcaagaacttaatgatcatcagggtcttcttgcaattctcgaagcttattccttataatctcaagctgattgatgcagcctcatacatgttcatgttcaagataggaagaagggaggaagagtggcatcttcaaatcaggaaaccagtaatttccaagaaatccccacctgcagctaactacttaggtctcattgcccataatgagacatatgactacctgtagtcacaaggaatgctgggaaagcagggaatgttctggcatagtgatcattgcctgggctgggcccattgacactgtatgcaaaatttgggttctgttagtgaggaagaggagagtgtttattgagtggccagctaacagtgttggacttacataggttgagaaatgaatgggaagtgagaaaatggggacagtccatgtctatgacaccttaagaggcagttctgaggagtatggactagaaagggtggtagccagagtagaatatggggaaataatggaaggttacattctagaatatgaaaggcttgagtacatgtaaatgttgatgtgagtgggagagattgaagatgcaccggagctttcacaccccaggacaatacctagagacttgggatgggtgagggctgtgcttttctattgtaaaatggcagaaggggttcatataggagcttctgaagacaaatcggttaataggaaagagcatatacagaggcttaggatctggaaatacagtcatttaaaactatccatgttcagtatccatgtgtttccagtttaaagactactgctttaaatcatataacagtttctgttcagtcattagcatttccagttctatgtgataatcacaagttgaatgctgacttgatgttaattttctccccctccccagctagggttggcctcgggtagggcattgccacagggagggtgtgtgctccctttgagtctcttaccccagagtttcttgccctctgggtttggagtgtaggatgaaaggaggggaaagtggggcagggaagtttctgtttctttggtgattgcagtatggctttgatctctctggtccctggcaggtgttcagagctgacttattcgcaggtgtcccatttccttgctgagccaatttgtcttccctctggttagtatttacttgactcatgcaatgtacgtttttatttctggtggtactaactttttaaggatcctcttgggaagtatctccttaacttgggactcacttctggtcccagggtttaccaggctttgatctgccttgatgtttggggtgctgtgtttcaatatgttcccatagattgtgttggaagctcaattgctactgtaacagtattaaaaggtgggcctttaggaggtgattaggccatgaggtcttgctcccgtgaatggagagagtttggcctctattttctctctatctcatgtgctccctcctcccttctgttttctgccatgggatttacccttgccagatgctggtgccatgctgttggacttactggcctccaaaactgtgagctaaataaatatcttttctctataaattacccaattgctggtattctgttatagcagcagaaaatgggtcaaaacaggagtggagttacttctagtgcagcagtgtctctctgtcttcccctctctctccctctctccctctctccctccctcttgttggcttaggccgaaagattcgaaacctttgtgtctatgtatttttaaaagttcacagatccattgacctgattctgatattcacaggggctccctacagaccaagcaaatttaatgggaaaagaacacttgacttcataaagaagaaatttaaaatatattttataagaaaaatgaataaaatttaagaaaataaaaattaactccaggtcctaaaaacaaaacattcagaaaaatagttacctacttctgttcccctcagacttgttctcagcaacattaaatgccagaaagcagcagaaattgcaatatttccagagtattgaggaaggaatagaatgaccctcaaataccatacttagcttgatgcatagaaggcactaattttgttgttgttgttaaacaaataccagaatgcaaatgtcttttctctggggatggttgcagaaaagtatgtgtaactcattgtacttttgtaaaagaaaaacatgtgtttgtatatgtaaatttaggaaaaaggtggaaagaattgtctcagactgattaaacccaggaatggagggaactttacttcttaattcttataatgaagtcaaagttttaataaaatttggtaatattttacattttgtattttttagtttttgaaaaataccatctatgtaaaaaaaaggcaaacactatcatagatcaaagcctaattatacagtttttttatttaaaacaagctgttcttgcatattcattaaaaaaaaaactcaggtatattatttgtgccagaacagtctttagacctatatttattggtgaactttaagaataaaacattgtcagcttcaaccttctatgtccttttaaaggtgattaaactttcctaggttggacaggatggcttgaggagaatgacgtacattaatttttctagccaaattatttcatgtggctcagaacccattcagtcattctattatacaatctgatcttttaaactcatctaaatagctactcgacattgtccttatcaggcctaggtcaatgataaaggtacataacagaataaatctccctaaaggaagaaaggaaaagattaactctctcccaaatccccatgaaacttcatgttcctacatggacctgtttgtagtctggtccccagacactgttgagatctgggaacacggggtcccagaaagaaagcagccttcatgattaattcactttcaaaggttctgccttaaccattcagggtgttctaaaaagaatcttctgaaagaccacattttgctatgaaatcaatcaaaaacaaaataccagtcagaatcaaactttttaaaaggtcacactcatagaggcctccaattcatgatcattgggtacatgttgacaagctttttaggaaactttagagatatatggggaagatatcaatctcatctgtcaactgtaattgaaaatgggcaaaaaaatacaaatatataaaaactggcatcagtgctggaaactagagaagggcattgcccaacttggagaagttctgcctgatatgatgcaaactgtaggaagccacatgggccaaatcgtagacatcctttctgaaaaaaagataggatatgcaaaaagtgaatacaagtaaatcctaccagaccaggctgttactgcgcagctactaatttctatgtgtgagagctcagaggggtcagcccctgtacatattgggaacatttattctagttggaacccattttcccagagtgggtccacacttacaatcatttgcaggaagcccaaagccgagcctgaggacagcaagactttttctggatatggtggacagggcatccaggaagtgtggggtcctgggcacactcagccaagactgggtggggccaaacctttttctgtttcctgtctcatgttcttgtgctgggacatttccttgattctgcctttttctttttcttttcttttcttttcttttttttttttttttgagacagagtcttactctgttgcccaggctggagtgcagtggcacaatcttggctcactgcaacctctgccttcgggttcaagtgattctcctgtctcagcctcctgagtagctgaaattacagggatgtgccaccatgcccggctaatttttatatttttagtagagatagggtttcaccatgttggtcaggctggtcttgaacttctgactttgtgatccacccaaagtgctgggattacaggtgtaagccaccatgcccagccaactctgcctttttaataagcaattctgatttcagttttgtccattctgtgctcactcttttttattgagttttcctcctttcatttttcatggtagccttttcttgttttgtgcatatgaaatcgtctcaaattttcctattaggtattaatgaaaactttaaaaagttcccctctatactttgattatctctgtttcctttggatcattctaaagtttcctctttgacatttcctgtcgcactcctggttttcctaaaatttctgtggtttctgattgtcagtgtatcagaatgaaggactagacccatcactgtaggtagctggggtaggtttttgtctgtttacctcacagtcttccctccctactggaaggactgagtataggggtgggtgtggtgatcagttttatgctagggtcagtggccaagggggactcagggaggctggaaagaagggttttaccttggaatgcagggctttgctcttgggcagggctgcctcttcatgttgccccttctgtctgttggaatgttgggaaagatctctagcttctctcagatctccacatccactttggggccatcagcaaagtccactctctttagagtgtgggtacagtcttcagcctggggacaaatgccccagttgcctgttgcttagttgataatattaatggctaatatttaatgagacttaacagtgtcagatactgttctaaatactttccatacagtaatacttacaaggcagatactgttataatccacattttgtagataaggaattggaagcacagagaagttcacagttgcagtggagcagagatttccaatcaaggtgctttaactaaagaatttgcctttgggtatagagatggcgtgtggggatgggggtggaggggctctgttgatccttattgctttccaccatacagttattttattaagtcccctgatgattccccaggctcactctgttctttttatttttacattgtttagacttggaatttctctgtatcaacttttatcttgggagcagttttctactatgcatatattggttggctttatcctcagctctctaatcccatctgctctctgtcttctaggaatttctcaccatttatgatctgtcactggcaccctttcttgtttttcagccctgttatagatgttatggatatgcctctctctctatagatatatctatatagatatatgtagagaggaatgtggtacacagagaagatgtgtgtatttggtccgccatcttgattcaatttctgtaatatttattatatgtgttttatcgatttacttcctggaagtgagattaattaattttttatcgtgctgctataatgattaaattttgaagtagcatttagcgtgcagggagtacagtcacaatgtaatagcccctgggatttttgttctcttgagtataggttattagactctgtatggctttgttgtgattctgctaaacagagacttccagatgcggattgtcagacatgaacattatttctactattcaaacagatagggacgaagtggtccagcattgcttgttaaacttccttctagaagaataaatcaggataaatgcaatcaatgtaaatattaaacacattgaatgcagggcttatggaaggggtagtttaatattttaaaaattgaaataaaatgtacatataggaaagtgacagaccacaagtgtacagtatgatgtattttaacaaagtgacacattcatgtgatcagttcaagatatagaacattagtggcacccaagaggaccccttataaccttaatttacaagtaactaccacaccagcttcaatcaccatagattagcttttcctgtttttgaatattgtatgaatggaataatgcagtatgttctcttttttgaactttatgtaattagacataaatatattgagcttctttcattcaatgttatgtctgaaatttacccatgttgttacatattatgggagcagttaattctttttcattataatactatatagtgttgtattgtagaaatagccacaatgtaattattaattaatatgggcatttgtttctagttttttgttattatgagtaatactatttttacatggattttggtgcacatatgtaggaatttctgctgggtagataccagcagaattgctgagtcatagggtatggttatttttatgttcagctttagtagattctgccaaactgttttataaaatagttgcaccaatgtatactcctacaaatactgtatgagtgttccagttgcaccattaatccttggaaacacttgtgttgttgttgttgttttaaagtaattttgaccattctgatagtaatgtagtggcatctcattgtggttaatttgtatttccacgattataattaggtgaaaacattttcttatgcttattggccatttggattattgtcttagtccttacaggctgccacaacaaaaataccatagactaaatggtttaaataacaaatatttctcatgcttctggaggctggtaagtccataatcactgcactaccagatctggtgtctgataagggccttcctggttcacagatggcagtcttcttgctgtgtccctgtatggtggaagagtgggagagctttctctgaagtctcttttatatggtcactaattccattccagagggatctataatacctccatggcctatcatcttctgaagactctacctcctaatagtatcattgggcagttagaatttcaatttatgaattttgaggggacgcaaacattcaagccatagcagaaatcttctttttgtcaaattgcctatacaaggctcctttgactgttttttaaaatattgaatctatttgcctttttcttcatgactcatcagagttctttttaatatttgaatgtgattctttgtcagatagatgtgtggaaaacatcttctactctgtggcttgatatttctcagtcttctcttaggtttaatgaaatacaacatatgaatccttttcttgagagttagtattttggggtctggttgagatatcttctatcctagggttatgttatcttgtagatatcataagattctaaaatctttaaatttttaccttaaacattattttaaggtcagtgaggaattatttttgaggtatggtgtaaagcaggggtcttaaattatttttaagaatagaaaggatacctgaaatcagagaatttgagaactggtgatttaaagctataaaattcccaaacaacagctttagctgcatctcgtaagcttaggttatatctatatatttgcattccttatttaaaaatattctctaatcttcatctttgactcaggctgtttatgcatgtgttgtttaatttccaaataattggaacattttcagatattgatttctatattaatttttatggtcagagaacctactctgcatgattttggtctttgaaattttagaaatgtgctttgtgattccgcatatggtctattttggtaaatgttccatgtctacttgaaaataatcattattttgtagttatttgctacagtgttctacatatgatggttcaagtcatgttaatctactgattgttttcgtctgcttgttttataagttgctgaaaggtgtattaaaatatttaaaaatatttggaattgtttctagttttagttttataagagtatgctttatacatcgtgaggctgtgttactaagtgcttaaagatttaggattgttatgtctcttttaaattgactttttacaattgtttaaatgttctttattctagtaataatgttttctgtataaaagtctattttgtaggatattagtatagattctaaaggtttttattgttgatgttagtgttttctttttttaaatttaaaatttctatgggtacatagaggcgtaagtatttatggcatatatcagatatttttatacaggcatacaataagtaaggattattacaatgtgtaatgattgtcagggtaaatggggtattcctcacctcaagcacttatttctttgtgttatgaacattctaattgtacttcctcagttactctaaaatgtacaacaaattattgctgactgtagccactctgttgtgatatcaaatattatctcttattcattatatctgactatatttttgtgcccattaaccatcccgattccctctactcccctgctacccttcccagcctccggtgaccatcgttctactctctgtcttcatgagttcaattgtttaaatttttagttcccacaaatgagaacatctgatgtttgtctttctgtgcctggcttatttcacttaacataatgtcctccacttccatctgtgttgttgcaaatgacaggatctcattcttttttatggctgaatatgtaccacattttctccatccattcatctgttgatggacacttagattgattccaaatcttggctattgtgaataatgctgcaataaatatgggcagcagatatctctttgatacactgatttcctgtcttctttcctagcagtgggatggctggatcatatggtaattctatttttttttttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggtaattctattttttgaggaaattccaaactgttctccatcgtggttgtacatccttaccaagggtgtatgagggttcccctttctccttgccagcattcgttattgcctatcttttggataaaagccattttaactggggtaagatgatatgtcattgtagttttgatttgcatttctctggtcatcagtgatgttgagcatcttttcatatacctgctagccatttgtatgccttcttttgagaaatgtctattcagatcttttgctcatttttaaattttattattagattctttttcctatagagttatttgacctccttttattctggttattaatcccttgtcagatggatagtttgtaaatattttctcccattctgtgggttgtcttttgactttgttgatgttgaaaagcctttgctatgcagaaactttttaacttgatatgatcccatctgtccatttttgctttggttgcctgtgcttttagggtattactcaagaaatctttgccaaaatcagtgtcctggagagttctcccaatgttttcttatagtagtttcacggtttgaggtcttagatttaagcctttaatccattttgatttgatttttgtatatggtgagagatagggatctagtttcactcttctgcatatggatacccagttttctcagcatcatttattgaaaagactgtcctttccccaatatattggttcttggcacctttgttgaaaaggatttcactgtagatgtatggatttatccctgggttctttgttttgttccattggtctgtgtgtctgttttttatgtcagtatcatgctgtttggttactacagctctgtagtataatttgaagtcagttaatgtgattactccagttttattcattttgctcaggatggctttggctattctgggtcttttgtgattccatataagttttaggattattttctctatttctgtgaagaatgtcattggtagtttgataaaagttgcattgagtttgtaggttgctttagtaggtatgaaattttaacaatattgattcttccaatccatgaacatgaactatctttctatttctggtgtcctcttcaattttttgcatcaatgctttatcgttttcattgtagagatatttaacttcttgggttaattcttaggtattttatgtaatttgtagcaattgtaaatgtgtttactttattgatttctttttcagattgttttttgtggacatatagacattctactgatttttgtatgttgattttgtatcctacaactttattgaatttgtttattggttctaatacctttctgatggagtatttagatttttccaaatataagatcatgttatttgcaaacaaggataatttgactttttcctttccaatttagatccctttttttctttatcatctgattagctacttttttttctttatcatctgattactccagtactatgttgaataacagtggtgaaagtgggcatccttgtcttgtcctttatcttacaggacaggcttgcattttttcctcattcagtatgataccagctgtgggtctgttgtatatggcttttattgtatggagatatgttccttcaatatccagtttttttagggtttttataatgaagggacattgaattttatcaaatgatttttcagcatcaattgaaatgatcatatggtttttgtccttcattctgttgatatgatgtatcacactaattgatttgcatatattgaaccattcttgcattcctgggttgaatcctacttggtcatgatgaataatctttttcttgtgttgccaaattcagtttggtagtagtttgttggggatttttgcattgatgttcatgagatatattggcccgtagttttgttgttgttttgtttgtttgtttgttttttgatgtatctttgactggtttaggtatcagggtaatactggcctcatagaatgggtttggaagtcttccctcctcctctattttttagtataatttgagtaggatttgtattagttcctctttaaatgtttggtagaattcagcagtgaagccatcatgtcccaggcttgttttgccagaagactttgtatttcaaacgagatcaaatgagaggtttgatcttgttacttgtcattagcctattcagactttggatttcttcatggtttaatattggtaggttgtacgtgtctaggaatttatctgtttcttctaggttttccaatttattgacatattgttgctcatagtagtctctaatgatcctttgaatttctgtggtattggttttaatgtctccttcttcatccctgattttatttatttgggtcttctctctttttcttagtctggctaaaggtttgtcaattttgttcgtcttttcaaaaaaaccaactttttgttttgttgaccttttatattgccttttctttttcaattttatttatttctgcctgattttaatttttttttctttactaattttgggtttggtttgctcttgcttttctagttctttagatgcatcattaggttatttatttgaagtttttctacttttttgatgtaggggcttattgctataaattttcctgttagtactgcttttgctgtatcccataggttttcgtatgttgtatttccattttcatttgtttcaaggaattttaaaatttccttcttcatttcttcattgacccactggtccttcagtagcatactgtttaattttcatgtgttcgtatagtttttagagtttctattattgatttctagttttattccattgtggtcagagaagacacttgatatggtttatccttgagaatgattgctgaggagaagaatgtgtattctgcagctgttggatgaaatgttctgtaaatatctatgaggtccatttggtctatagtgcagaataggtctgatgtttctttattgaaatgctaatgagtagtttacacaccacaattacagtgttattatagtctgtatttgtctatgtacttactgttaccagtgaattttgttccttcagataatttcttattgctcattaatgttcttttctttcagattgaaaaactcccattagcatggtgagtattagggagtgaaaagctcccattagcataggtctgatgttgatgaaatacttcagctttcgtttgtctgggaaagtctttatttctccttcatgtttgaaggatatttttgtaggatacaatattccaggataaaatctttttccttcagctctttaaatgtatcatgccactttcttccagtctgaaaggtttttactgagaaatctgctgccagacataatggagattctttatatgctatttttttcttttatcttgctgcttttaggatcctttctgtattctttacctttgggagtttgattattaaatgtcttgaagtagtcttatttaaattaaatctgcttggtgttctataccctttttgtacttgaatattgacatctttctccaggtttggaaagttttctattattatctctgtgaataacctttctatgctgatctcattctctacctcctctttaaggtcaataactcttagatttgcccttttgaagctattttctagatcttgttaggtttgctctattctttattattctttttccttttgtctcctctgtgtattttcaaataggcttgctaattcattcctctgcttgatcagttcttctgtttagagactgatgcattcttcagtttgtcagttgaatttttcagctccagaatttatgcttagttctttttaatgattttaatctctttgttaaatttatctgataggattctgaattccttcactgtattatcttggatttcattgaacttcttcaaaacagttcttttgaattctttgtctgaaaggtcacatatctccatcactctagaattggtcactggtaccttatttagttcatttggtgaggtcttgttttttctggacggtcttgatacttgtggatgttcattcatgtctgggcattgaagagttaggtatttattctaatcttcacaatctgggcttgtttatacctatcattcctctgaaggctttccaagtattcaaagggaattgagcatttgatctaagtctttggtcactgcagctatatgtgcattagggagtgccctaagcccagtaactctgagtcttgcagtcttgtataggtgctgcctcagtggtcttgggtaagatctgggagaattccttggattaccaggcagagtctcttgttcttttcccttactttcttccaaacaaatgcaatctctctctccatgctgagcttcttggagttagtggaggggtgatacaagcactcctgtgaccatcactgctgagattgtgctgtgtcacacctgaagccagaacagtactgggtcttgcccaagatgtattacaactatttcctgaattctgctgatgtttattcaagggccaaggactctttagtcagcagaagttgattcctgccagaaatggatctttcccttcagggcagtggatttccttctggcccagggtggatctagaaatgcagttcaggagctagggcctggaactgggggctgcaggagtctgcttgatgctttactgtactgtggctgagccgctacccaagttgcaagacaaagacctcttttttgctctcctttcctcaagcagaaggagtctctgcccagacaatcactgcctcaggcccatggcaactatagcttggctactgctgatgtttattcaaggcccaaggggtctttattcagcaggtggtgagttctgccaggtctgggtctctcctttcaatgcagtgggttcccttctggcccagggtgggttaaggaatgccctccaggagctaaggcctggaactgaggaaatgagaaatcctcttggtgctttagtttactgtggctctgctggtacccaagtcacaagatgaaatcctttttacacttccctttcctttcttcaagcaggagcctttccctgtggatactatagctgagaatgtgctgggtcacacatgaaaccagcacagtactgggtcttgccaaggcctgtgatgactgctgcctggctacagatggtgtttattcaaggcccaggggtgtttattcaaggcccaagggctcattagtcagcaggtagtgaattctgtgacactgggtcctttccttcagggtagagttcttttctggaccaggatgggtctagaaatgttgtctggaagctatggcctgaaatggggtctttaggactttgcttggtactttattttactgtgacggagctggtatccaaattgcaagacaaggtcctctttacacttccctcttcttacagaactgtgagccgcattgcctggagttggggaaggggtgatgcaagcactcccttggccactccagctggtgtatccctggaaagttctctattaataaagtttcctgggttgcatgcaccccagttccactggctgtaggcccagcagagcaccagtatttgtccaggaattgcagtccttgtggcctagactgcctttcaagtttatttaggaccccagaacactttatcccacagtggtggggctagccagaactcagtttctgactgctgggatggacgattgccctttggctagggctagtctaagtgctccctccacgggcactggccaaagccagtgggaaacactaggaaaggcctgtgttgctttccactgtgacagggcagcactgagttccaatgcaaattccccaaattactttgcccttcctcccgcaagtgcacagattctctctccatgccatgctgcactgctgggggatggaggaggagtagtgtcggcaattcaaaactatcattcctatcctcttcagtgcctctttcttggatacagagttaaaatcaggtgctgtgattgctcacctgatttttggttcttatgaaggtgatttcttgtgtggatagttgttctatttggtgttcctgcaggggggacgattgctggagggttctgttgagccatcttgctctgcctcctcctccagaaatcagtgttagtgtttttctgatgtatctttttgcacctgtttatttttctttcatgttattacctttagtgtgcatctcttattagcaggatatagtgtagcttttttttttttttttaaatgctggctgatgcttcttgtcttttaattggaatatttagtccattttcatttaatgtaattattgatatttttacatttaaatctgctatgttattatttgttttctatttatctcattcattctttgcttctttctcctttcttgccttcttttggattaatccctttaaagaattattccattttactactctagtagcttgctagttatatattattttataattatttaaaaagcaatactagaaattataacacacttttttttaatgtggtggtgtcttcattaaattagtactgtatcacttccaagcaatagaatagaccatacaacaagagtctcacttaactcccttagtggtggcttttgtgctatcatttttatgcttttgaaattctacatacatttaaaacctcacaagacattacttttattttaagctgtgaatattcatttagatttatctttctggagctcttcatttctttccctattttcttatttccatttgtttccatttatatatgtgtgtgtatatataataaaaaattatatgtgtctgtgtttccatttatatatatttatatatataaattcacatatattacataaatgtgtatatatataatacatacacactacatatataattttttaaagaactccctttagtgtttcttttggtgtttgtccgttgtgagaaattctctcaatgcttttgtctgaagatttctttgatgttgcctgtttatgagggatatattcattgacagggaatagaatctaagattggtagatattttctgccagcattttaaagatgtgatttcattgttttgtagctccttgatttctcttgtaacatcagctaagaatctttttgttgctcctttgaatgcaatgtgtatctttctctttgtctttggtcttcagcagtttgactataatgtgcctaggtatgtttatcttcatatttatcctgattggtattcatagagaagtttcaatctgtagcttggtgtcttttttctattttgaataattattgtccatctcctcttcaaatattgtttcttttcatttctttgaactctaaaatacacttgtgttaaggtattttcaccatgtctgatgtgcttatagtgctcttttttgtgtttttcatcttctttccctttatgtttcaatttagatactttctactgactgaacttccagttcacatattctctcagttgtcgtctaattgttattaaacacttctgttgggttcttaattttagttattggattttcatctgtaattttcatttgctttctttttatgtattccaatttttgataaaaattttacattgtcatttattttattcaacatatttatcatagttacattaaaaatcatttctgatgtcaatactgggattacctgttggatcatctaattcttttcttagttttccattgttggttcagtatcctggtatgccaaattatttttatttgaatggcacatattgtgtgtgaagaattgtagcaggtctgagtaatgtatcttcctccagagattatctagttttattctggcggataatgagggtaaaggcttgtaaccttgctacaggtggattgaaatgattcaagtttgcattccaggctttgtgagggcatgtccccttgcttgcttttactcctagggtttaggcattcagggatgaattaaaatcccagatgtttttccttattggggagtcctgactccaatttctgtctcttgatcactgtgatactgcagaaatacctgcttagatatttagccttctagcagcctctttgtgctggtttcttatcatctgccttgtgtattcagcttaggaaatgtcaaaagcctcaagaggaaattgaacatagcttgtcaggtttgcttctttatgtttccctttttcccagaaatttggcctcttatatcctggtttccttggttacagtgtattccaatttttctcttacacaacctagtaagactgctgcaagttccaggctggtgttttctgctcagactttatgtcctatgttgcaagacagaacatttcctaaagagaacagtcagctgtagatgtatcactcccctcaatgcatttcccttcctccagattttggcccctcagattgtggctgtcttggttgctccgatgacctcaagatctctttaaacttggaaatttgaaaaaattttagacttacagaaaaggaagttgcaaaactagtacagagagttcacatatacccttcactcgtctttccctaatgttaacaacttacatattacctttactattgatacttaaaattgtgttgccatgttctccaagctgataacaacagagcatgactgccaactggttgaaaggagaaaaaggaacctttcaaaagggtgacatttttggcacagggcttctcaaaatgtgttccttagaacaccagtccttggagattttcctattagacaacgtccacagcccagtaattgtaggaaatgccacatcttacatatatgtgcccctttggaaatccacagtgcccattaccattttattttatttattttttttgagatggagtcttgctctgtcacccaggctggagtgcagtggtgtgatttcaactcaccgcacctccacctcctgggttcaagtgattcttgtgcctcagcctcccgagtagctgggattacaggtgtgcaccaccatgcctggctaatttttgtatttttactagagatggggtttcaccatgttggccaggctggtctcaaactcctgacctcaagtgatctgcctgctgtggccttccaaagtgctgagattacagacatgagccactgtgcccggccctccattaccattttaaagcctctgaaaatgtttcagtaaagaaatctgcttaattttgttttccctgtgtttccaaatatatatagtcaagagctgtttttgtttttgtttgtttgtttgttttactttgcctggcccttaggtacatcccatggagctagtgttttgtggcacacatactggaaaatactattctggagcattttctaaaatcctaagttacaaattttgcttttttacattttctcttaggttccggctttcttgctgtttaatttcttgcttcatgaaagggaagaagatggagacgccaaggtttctttgaaaacagatatttgcacgagaaggcagccaaggctgtgttaacattcaccattaaaaacccaacacatctagacaaaacaccaaatgcaaaagcttcacgtttcccaaataaatttcttttataatttgtcactgctcggttgtaggctttgaaaatagttttcattttcctgttattgacaaaattaaagctgccaagaagtagatggtgaacaaggattttatctctgactgtagcaccaaggcaacctgagataggtctaatttgcagcataaatcttcttttccactgggggaagaacacacgagccacattgagtagccacccatttgtatttttgatttgcaacttctgtctagtgagccaaggtcaggtgcgatatttgtgatggggaagctgaataggtgagtgagggtagcttgtgtttgaagctgaagaaggtaattaagagggttttagaatgtaattttggcatttttccccactccacctcttcaaactatgtgtcccctgtcatcgcctaaccgatctgcctgtccaccttctggttcctctccagtccattatctcatggcccacttgactaatctttctgaaactcagatctgttcttatcactcacctttctaaaagtctccattgtccccagaattaagtttagccccatggtctggcccctgagtgtatgcctgtctgctccttttcatttaagcttctgttacccttgctgaattattatgctgtttcctgttatgttgtgtgcatctcttagaagctgcatatagctggattttttaaaatccactctagtattatttagtatgttgaatgtaatccaattgtgtagataatcattactgatctatttggactctctattttttaatcagccatttctttgcttatactattctttctgacagaaatgccacttttcttcttatctccctggtgaactccatatatcctactaggctttgttctggaactttcttggcaccttctcatttatataattgcttccttccatctgggttttaatggcaagttctgcatctctattacagaatagtattgatctcattgtggattgctgtttgtgtttctgctttccagtgggcctgtgagagtgactgatctttgcatctctagcaaattggcacagttggtagactttccaacctgagatattagatgtttcagaaattagattgaatgacgtggtgtcagtttgaaacattaaattgaggtgttctttgaaatgtatttaaggttatacaatgatttttgaatacagctttagctgcataccacagattttgatgtataatatttttattgttgttaaattttttggtaatttctattggggttttctttttaatctgttatttaggacagaattttaaaattttgtgctgatatacttatttttattgttggttcctaacttaattgcattatggttaaaaaaccccaaaacctaataaacatgctctatatggtattgattgactttgttacgtagtattaggttggtgcaaaagtaattgtggtttttgccactacttataatattttgcagcaacataatatatggtcagtttttgtaatgttctatctgtacttgcaaggaatatacattttttaaatttattggctgggggatataggtatatgtgcataatagttgaccaaggttattattttggtcattcagataatcaatatctttttcaattttttatcatgtttgatatgtcagttttctgatggagttgtgttaaatctcctgctgtaattgtgggtttatcagtttcactatttcagttttgctttatattttttggaggttatactaatagtggaaacaatatcattattataaaaattttggtggattgctccttttattattacattgagtctctattcctattaatgctttgccttaggaaggtatttcttaggtcaggcacagtggctcatatctgaaatcccagcactttaggaggtggaggcaggaggatcgcttgaaccttggagctcaagaccagcctgggcaacatagagaaaccccatctctacaaaaatacaaaaatgagccaggcatgatgctgtgcacctgtggtctcagctactcctgagatcacaccactgtactccagcctgggcaacaaagcgagaccctgtctcaaaaaaacaaaaaacaaagacaggtagctcttgtctgatattactgctgcaggctttattttgattagcattttcctagtatgtacattttgtcttttcagtctttctatgtgttgtgttttagttgtgactcttagaagatgtatatagctagattgttaaaattcactctattattatttagtatgttgaatttaatccaattatatagatgatcattactgatctatttagacttattactatctgattttgtggtttctgtttgccattccttcttcctccctctccctttattctcccttgttttcttttggattgaaaaatactggttttctaacagtgtgctggtatggatactatgttataacatgcatagttctatatgggtatcatagttttgtgtttttaggagttaccattagttatataacacagatacctgctgtgcattattgtaatgatgtctaaagttatacccatttctcacctcctcctgaacacacatgaatcttagtgtgcttgaaatatccactcaacacccttccccatttctgtgttattattgctgaaggttttaattttgcccttgtgtaaactcagacacattggtttttgcttgtttgtttgcctttactcaatggtaaatttaccaccatagtttctcaatttttattctcaccgttgtttcctatggtccatactttccctcttggttcggtttttatttccttgatgtaatactttagcatcactgttatttgagtctgtgaagtctgaatatgtctttattttctttctctcgctcttttttttttttttttttgagacagagtctcactttgtcactcaggctggagtgcggtggtgtgatctcagctcattgcaacctctgcctcccgagttcaagtgattcttccattctcccacctcagtcttctgagtggctgagattataggcacgtgccaccacatccagctgattttttttttgagacggaatttcactcttattgcccagactggagtgcaatggcgcgatcccggctcaccgcaatgtctacctcccgggttcaagcgattctcctgcctcagcctcctgagtagctgggattacaggcatgcgccaccacacccagctaattttgtgtttttagtagagacggggtttctccatgttggacaggctggtctcaaactcctgacctcatgtgatccaccacttcggcctcccaaactgttgggattacaggcatgagccactgcacccagccttgctcttaaacaacagtttagggagacagaaaattctagatttttattgcgccaccacacccggctaatttttgtatttttagtagagacagggtttcaccatgttggccaggctggttttgaacacctgacctcaggtgatccacccgcctcaacctcccaaagtgctgggattacaggcatgatctgtaatcccgtgcctagccgatttcttcttaacactttgatgccattccttcattgtccctggcatctgctgttgcagaagagaaatctgctgtcaatcttattgttgctttggatgttttttcccctgcgatagttttaggattgtttatttttgaggttttgctgcgtctgggtgtgaattaatattcatcttgcatggtacttgagtgtgcttccaaactgtagactcctattttccttcaattacagaagataaaagagccattttacttgtaaatattgattctcctatattctgttgtttttttctggagtgcctgttggatatatcttggaatctctcacttatccttcatatctattaactgatatttccttaaaaaaactcttcatctctgtttattttatgttctttaagttccttaatattttccagcttaccagttctttcctgattgcgcccaggctggagtttgtcccatctattgggtttttcatttttatgactatataatactttttgtttctaatgttttatgtctatcttgaaaatttcttcccttttgtataattgtttgctcttcattaatagaagttattcctttatctatcattttaataatatcctaaacacacattaaaaagtctatattgtttcataaaaccgttttctctagaagtgaattcatgttatgttatgtgattttgtcggctctctttcttggtgttatattttattcatgtgccttggaatttagatctaggatgaattttaattccaacttcttgtgctcacttctctctagtgattgtggcttcttccacccagcttcccaaggccccagtacaaaaccgtggtttctgttctgtggtgatattggggctatctggatccagtcacagagctggagggggtggggatgtgacttgactgattctttgttcttcagtctccttgggcctgcagattgccacatgtggtagcatcagacaggggtttacatctgaattttttttcccagcctcatttgcttttccatccccagctgtaagcagaacttgaacccagactctggtctcatggagcacttttagatccttttgtactcagcaggaaccagactgctggctgtcatagcctgtgtgcaggcaagaagcccagcaggcccgaggcttcaaccttgttcatcatgttgtgtttctgttcattttcagattcacaaaaatgtttattctgtttttgagcattgcttatctttctggttttctttttttgatatttaatttatccttgctatgtattcaaggcataaagagtgcatattttgatatttaatctatccttgatttgtattcagagcatagggagtgcatcggagttgaatttgaatagtcatcttcaccagaaatagaagcttgagtatttatatttagcttccagcacctagaggaaataaccttgtaaccttggaaggaggccaggtgccctgtaggaatcacgtctatctttttttatctttctatcccaagtaccagtcatgtccctgcacatagtagatgctcaacaaacaatatttgttcattgactgacctctgaaatataattacgtggcctaaacagctaatgctatatgtgtatttatacttaatgtatcaaaacagtaaacaccactgggaaattcaggaaaagcagaaacgaatgatcatgactcttaacctgtgactcctgttgaaaatgatcccatatgttgtcttttcaaacaagatatattcatgtcactagtttctgttcttgaaagtagaaacactactccttctattagacattttggtttctgaaaatagaacaagtaaaacctgaacaagtgcgaactcgttcggattaaagggatttcgggtccaactctccaagccaaagggattttcaaatggttattttaaaacgtggatctacatgtgggcttctgtggtttcaatagtcacaggaaatgcaggccactgtatcagtcagcttttgctatataacacaccatccgaaaacacagcgacttaagacaaaaaaaaaagttcatttagtttatgattctgtgggtcagcaatttgggctgggagcactgggtgggtggatgtgctggtgtggttgatcgctgctgggctcactcacctgttgccggtcagctgccaggtgagctgagggcttgatggcccgaggttgctcaggtgggatggctgatctctgatccacgtggtctttcattctccaacaaggcagcccagacttggtcaggtggaagcagtcacagcggacctgacagagtgagcagaagtatctgtagagcctctttgtgagtactgatttggaatttatagctatacagtgtggtttacactcttctattggccaaagcaagtcgaagcgtggaaaaatagacttcttaatgagaggagctgcaaagcctgtggccacttttgtactctaccatggcaacaaaacgtggaggtgccactccccaccccaggagagattgtgtaactttccttagatcctcaggctattacctccaaagttgagaaccaatatgttggatgatttcactactgaacaacaacaatgaaaatgtttaggagagttaactgatggacacatctgttaaaacactgcttggtgtgtggaaatgaaatttttcattttttctattggaagttatgccttgtatcaagacattaggttaattctctctgacttctgtactcagcctgaaaagtaaggattcttgttcagtgtaccagataacttctattatgtggcaaaccactccaaaattcagtggtttaaagcaataccgtttattggactcctgttcccatgcctcagcagatggggctgatctcagctggggtctctcacgttactgcagtcacctgcaggtcagctgggtggctctgattctggggatggactggttgtaccttggtgggtgtctgggccacttgtttctctccattcagttaatttgcctgggcttgcttgttcacagggtagcaacagtgtttctagagagtgagtagaagcacacaagatctcttcctgcctagctaggcttgtttctgtggggtcaaaacaagtcacaagcccagcccagattcactaggtgggaagatagactccaactctagctcggaggaactgtaaagacgcaggacagggaggatggagaaccctggccattttgtagtcttctgtatctgttgtcttcaagaaattccttctcacacttcgaatttaagtaaaatactatctccacttatatttttcctattaaatagtaataccgcatgtgtaatagtagtagtaactacacttgtatttaaaacaacctgccatcttttcacctttaattgatggcacctcccttactgtggatttgcatattcatattactattttaagggcgtagattatgttaatgtgttttgctaaagaaaatgattgaacttattttcttcttccaatttgtcttcctcgttctttaatccaaccctactggtgccagacttgcttttctaaagggtttctctgtgtttgatgaagactctttagggatctctcactcgtactctttagcttggcatttgagaatccctgtgctctgggcgttgcgtaactttcagattttattttcctccattcttccttgtgcactagttttcacagttaaacacaatttattgctgtttttttttcttagcacattggccatacacaaattgtcctcagctcttgggcaacatttttggttgttacaaccgtgtgtgtgtgtgtgtgtatatgtgtgtgtgtgtccatgcttgtagtactggcctttagcaagcagagaccagggttgctgttaaacatcttgcagtgcacaggacagcccccacaacagataattatctgctacaaatatcaataaagccgaggctgagaaaacctgtcctatccattcctgcccctggctcttttttccatgcctcatcccagaaggcctttccttcagtgccgcccgatgaaatgttctctatccttaaaatgccagctcaaatgccacatcttctaggaaacacatcccgcatgaacctactcccagtgccgtgggctctcaaagtccattctgtgcatcactgaagtgactaccacttagttcatttacagtaatttgtctctagtactattattttttaatggttcttattgttcttttcttgttttttaattgaatgtttgtgtgttgactctttgggtgaactgtgtgttccttgatgacaagtatctctcttgtctatgtcctacagcacttaccatgtgttttacacatagtaggtgcataataaatatctgttgactgcatgagaaatgtatgtcttcctgtgcctttagatatggttaccccttccaacaattttcttaaaggagttagttcaaaaaatccaacaagttgaatccaagtttttttgtttctgtttttaataatttaggtaaaaaactgtgacaagaaatcattgtacaatgcaattatttatgtttatttctgcagctatttagtgaaaaaataagtggtgctgaaggaactaaactagacgatgaatttcttgacatggaaagggtaagagcattttaatatgtaaattgattagaaactgactttcattgtgatatgagatatactgctattgtaaaggatattcgagtggaaatctaggatgtttaaatataggtgtggattatgcaatctacaaggcagtactttcccacgtcccagcccaaatcagatcctccccctgtagccacatgcagtttgggcaggtcgagtaatgagatcgatgtggctaactggtaccctctagtggccagaagtcagaatgtgcaaaagatgggcaatcttggcagttactgcaaggccaaagtaattggtagtatatgttttggagaatcaaaatgtatttctgggacaagattttttgaaatgcagaatgatttatttaccgtgtggaagacttgggctctgctcccatgtgttgcaggagctgcatagcaagtaacttttatcctggttctgcctgtagaaccagagtgtgaacttggataagtgaattcatctttttgaactgatacagagatgacaagtgtgccctgcttgtctcacatggattttgtgagaattatgcaaacattaacgtatttgaaataacttacaaaaaatatgacgggcttgagacagaaatgattgtaacatgctccaaagaaaaatggtatcatctctgtcccttaacatgtttcccagtcagctgtgtggagttgctcaggtggaggcagaactagaaccaccagtattaacaacatactgtttctttgctcattgtctgggccctttaaacatagccttgttttaataattagaccccccaccccagaggagagagggaggaaatgaagcaaggcatccaccctcaggtgtaacatcaaggctgcagatacagtaggtagcagagatgtcagcaggtgctggggaaggaagtccagccccaggctgcgcactgcctgggagagtatctccccaggataccttggctctggccagctcatcttccagggagttctctgttttctggatgagaactattaaatgtctagaaatgttaatgccttgagggagaaaagcttattttgtttttgcttttgaaagaaaacttaatttctgaaccttaaaaccatggaaacatgttcacaccattgacataccttaaattacttaaaaaaaactcttaatatacaaataggtgatgtatagctttgttactaacaaaatgattcagttgaaatgttaaatttaaaagcatttttccagagttttagttttggttgatggattgagatccttcttgcttacctccttttacctccaaaaaccccagtgagttacagaagaaatataaagtctattatctgttttattacagcagtgaaaagcatggaaacatataatacatgaccagaagttttaaaactttccagaagagatgcattagatggtattagacccacctaataaatgatacagaaatgagaaagtaatgggaaaaaatattctataattaatgctaaccatataaaaatagaggaacaatagtaaaatcaaaataaaatttgatgcaagagaagcactaaattaaaaaagctttttaattataaaaagatacagtcaatgtagtctatcaggaaattataatagttatgaaccattctgcactacataacatagcatctgaatttttaaggtagaaactgtcagaaatacatagacagttgataaaaatagaagtagacttcacatacctctctcataaaataatagattaaactgacaataatcaataggctcatggaggatttgcataaaatatgattaataactttgattataaataaatatagatatctgcattccccaaatggagaatgtgcatatttttcaaattcctttggaacaaatatggttatcaattatgtactaggttatagaaaaaaaaactcgataaatttcccaaagtgattccatagaacataagaattataagggaaagtagagcttctaaattctggatgtttggaaatttaaaaatatgtaaaaataattcttagtttaaagaggaaatggaaagtaaaatgacattatttaggcatgagtgacaattctgtatgtcaaaacctgtgatatgtggctaaactgtaaatgtatttaaagaaaataaatgttgggagaaaatgaataaatcatgcaatccaagaagctaggaaaataacagcaaattaaatcactctaggtagaaggtagaaatcaatatggataaaaaaagagattaataaaatagaaaacaataaccacaaaagatcgaaacaatgaagccaagagctttagaaaagctgtaagacaacaaacctctaccaagtgaggccaagagggagaaaaaggaaaaacacaaacaaattacataaagaagaagaaagaggatatgcccactgatagcattttttaaagagaatgctgtaaataagtgtcagaaatgagagctgctagcagctctctcactcagggactgggcctaagggagtcagtggcacaggccttgggacacctcatgggcagggtgccagcattaaacagaaattccagacttaactaaccaagatgctgtcataccaggttgacttcacaaaaaataatttttaccattctgcttccctctatttttcttaatggtttggcaggatatttgcatagcatttggttgacttgaacagacacacacacacaacacacacacacacacacacacacacacacacacacacacacacacacacactatagtgtccctagttattctaggagggagattttgtttttaagctacatgagtttttgttgttgtttttttgttttgttttgaatgctcatcttgactccacattagccaatatgtttactcttcaatttgtaaagggtttatttctagttttgatgcttgggctggtgtggaggcagctccagtatgtgcatgtcagggcctacaaggtacctgcaagtttttggtcatttgtttcttgggcttttttgtttcaaaagatataaaaaagatctgaagtagaaaatatccccattctaattcctctcatcatcatctttcagagatgactcttagctttgtggtggcttttcatgtccaaaaagggttgtatatatcaaagggagcactctaagttatattttaattaatatctaatttgttacattataaatctaaaatcctcatttttcttaagctttaaactgaacttatgaatcttgtttccaaatttagtaattttgctatatgatgaaaatcattatagttaattttcatttgaggttgcattaattaacacataagcttaacagattcaatccttaaatatttaccaccagttatataattaagcaaattcccttagacatttcaagctataatcacaaaggcaaggtacaggactccctcaaactttacataaaatctattaacagcattttcctaagcccttacatttcttgtgactaataagacatatttagttaatcagattctcttaaacatttcaacaatcttggcaaatagctgaacataccaaagagagctcaaagtcacaaaacttgttactaggccaaacgcacactcacatgcccacttgcacacacagcacacaagtatcagtaatataggtttgactccttttttatcatttctgtactgtcttttaaaactttcctggggctccagattaatttatttagcccaaattaatgtatttacctaaggggaacaaatacgatttcaggctggataagattgcttggttgcaaacttgtgaccctggcaggatcatagttttctaaattacaaaaatgatttgtcttctattataaatcattctgcagcttgcttgctttctatgtatgtactttgaatgtcgatcttccttattttttttccttatgattaaagagtattcctttacttggatgtttcataatttatccatcagtctcctgttgatttccattttcaatattacataaaatggcctaacaaacatgtttttccttcactgcaatttgctcgtgtgtttctaaaaggacaaatccttagaagtataatagctggtttattaatatgcccattaataagcacttctcccttgatctccaaaaacgtatcattttgcattcctgttgtgtgttactccacacccatataatacctgatattgagtataactgattttaaaaatgtttttatcaatctggagaatgtaaagcatctcctttttatttacagttctgaatatttttttcaaatctttgtaggcagcttgtgtttttcctcttttccttctttctttttaagacatggagtctcgctctgttgcccaggctggagtgtagtggcgtgatctcggctcactgcaacctccaccttccaggttcaagcgattctcccacctcagcctccaaaatagctgggattataggcacccgtcatcatgcccggctaatttttgcatttttgtagagataggatttcaccatattggccagcctggtcttgaactgctgacctcaggtgatccacctgcctcagcctcccagagtgctgggattacaggtgtgtcccaccgtgcccagccttttccttctttcttgtttgtttaaatgggagtttagaatattatgccacttttgtcaaacttcacatactctatgtcttttcatgttcagtttttaagtttttacggagtcagaattttggtctttttatttatgacatttgaatttcaggtcctggttagaagtttcttcccactccagtatttcaaaatactgttgtctgtatgttagtcgttttatagtctgatttttttaggttgatatttttaatcatgtatatagtatgaagactcactttactatcagcttgccaaattttaacaaaaaaaagaaaaaattgaaattatgatgggatttgaatgaattttgcatgttaatttgggaagaatgcatatctttacaaaattgagttttcccatctaagaatgtggtttttcaaataggtgttgtgaatttctcataatagttattcttcattattgcatttttattgcttttatgaatgagatctttttcttttgggctactgatggtataaataaagctattgcaacttgcattttaactttattgtttattcccatattaactctctggttaactaacaaccagaaagtccaggaatggttttgcagaaggaaagattcagtcttaaccagaaagggttaactttcagggaacgtttggggaaaactttgatgttaacatcttctgaccatagcacaaatgaatgtgtttattgtattataatataatactaatgattatgattcttttagtgttgattactgaggcagttgctaatatgaatcattactgtggcatccttatataagtatagaaattcaagttcacctagcagataaggagagtttggttcatatctagtgttagttttgagagacttccaagtatatctaataatctagtggagcataataacttttccagattttctaaatattaccttaatattcattttaatgtttaaagggaaagtaaagttctccaacatcacttgaaggaaatgatgttccaaaaatcagaaagtgagaaaatatcacctctcccaaaaatgttgaaaacgttcatttggattaaaatcatcataatcgtgttagaagaattaaattaatgaaaattcctcctctatttgctcttttgtgattttattgagtttgtcatttactaactttttttaaattttgcttttaagaaaatagatgttaccaataaagttgttgcagaaattctttcaaaaaccactgaatatcttcagccaaatccaggtaaagttgaaatattctcttgttcatttgctgtcacagactctaataacccatgtttacttggtgtttagttgacataatgtagaaacaatgtcgtctgtgtcccaataatgaaattcagtttttaaagctgagtctccagtgaccaaaggtagttgcattcggtcctactgatgagaaagagaacagctatttttgtgaatttcagttgacatcatccgaatggagtgctggtcatagcaacaagagagcactgagcaaaggttttatgagttgcttcagaaagccactaaacatttggcaaatattttcttccttatttcctctttataatttttttaaaaattctgcccttgtgtactatatacataaaggtatatgttaatttgaaaaagctttctctttgtggcttaaatgctggagaaacaagatgtggtgaatacgaaaggctgcttaaatccagtgtcacatcagcttctccactgaaggtctgggtttctaggtccccaagcagcatctattgatgagattttcccaggttgtaaattataggaaccaatagagggcgcccaagctttgagttctgtggatttctaaagccacctttcctttttaggaatttattatctgcgtagagttcctgtgattcccttgactgtaggaatcagcacaaacctaaccatttgaaaattgagaaagtaaaaatttaagaatataaattttatcaggtgtatccaggcaggtctaaagttctttacaattgtattgatgataatagctttgaaaaccataaaaatatatcttctcctccctggccacatcagtgattgaaatcagccacacaaatttcttttcctgatatatcagtcaacaaatatttaatatgtgctttctctgcactagaggatttcggggtgctggagtacactatgaaatcagacagatacttcaccctcaaccagctgactcttgaatgggataaggaagtgttggccaacaataaaagtgtcaccactggctagaggtctctggttattcctagagaagaggcagccctagcaacctcttatccagtttaatggctctcacccacatacctgctgcatcccacatccccctccaacagtgggaaagatgggcagagagagagagagagagagtgtgtgtgtgtgtgtgtgtgtgtgtgtgtgtgtgtgtgtgtagtgtgtgagagtgaagcctttgggcttggggacctggaggataaatgctttgaggataaatgtgaggttcaaaagtccggcactggccaggcacaatggcttatgcctgtaatcccagcactttgggaggccaaggcatgatgattgcttgaagccaagagttcaagaccagcctgggcaatgtagcaagactctatgtctacaaaacattttcaaaattagccaggtgtggtaacacgtctgtagtcctatttttactcaggaggctgaggtgggaggatcgcttgaacccatgagtttgtggccacagtgagccatgatcataccactgcactacagcctgggcaacagttgttgtttcaaaacaacaacaaaaaaggctggcactgtgaatgtcaggtgaatgtgagtggcactcacagctggcacgggaatgtcactactcacagtgcattctattgctggagatgcagaattaggctcaacccagaccgatggaatcactctacattttaacaagatccttgggttatttacatacacattaaagttttggaggcattgatttaaaatacattaaaaatagtacaaaattattaaagtaggaaaaaaagtgtatctcttgactatctaaaagtatctcaaataccacaaactagtatgtgattcactctctcacctacaggatgaaatctcaaatccttagcttggtgttcaattcatagtcacattttcccatagctatctcccactttgtcctgtattaatagcattttaggtcaaaccagcctactccttgtccactgattatgccacagtattccctcttctacacgttactgacaccattctctgtactttttagggcatctttccatctttcttcagcatattgccgcctttcccttgccctgcaccacactggactttattttcataattatgtcctgtatattctgcctcccagtaactagactttgagctccttgagggcaaagcctgtctctggagtcccagtaatgagcacagtgtgttgttgcacagggcccagtgcaacaatgagtaaatactcattgcctgagtcagaggaaggaaaggaaggtaagacgcagtgatgcgcatcacctccctagggagcagaggctgagctgcaccttgggaccagccacacaaggctagtgttcactaggggtggggtggtctgtcccctcctatgattctgcctcctaaacagcagcacctgcctgccataatactgaaaatcattaggctcaatcagtccttgggagcagagtgtgtgtgtgtgtgcgtgcgcgcgcatgtggtgtgtgttaatgaccagttggttgtttgaaatatcctcctcggcaattctatttttgtttacatttaaacaaacaaacaaaaagcatgtcagtgtcacacaggtgtcagtgtctgacttcacgtgtcagcaactgcaagctttccaaagggtctcactcgaggggtggtgctcaggaaagcctggtcactattatttcaagtcagcaatgtgccccatcatttctttttttttttctttctttctttctttcttttttttttttttgagacaaagtctcgctcttgtcccccaggctagagtgcaatggcgcgatcttggctcactgcaacctccgcctcccgggttcaagcaattctcctgcctcagcctcccgagtagctaggattacaggcatgtgccaccacgcccagctaattttttgtatttttagtagagacagggtttctccatgttggtcaggctggtcttgaactcctggcctcaggtgatctgccggcctcggcctcccaaagtgttgggattacaggtgtgagccactgcgcccagccgatgtgcaccatcatttctatggttcatcgtggctgcggaacagtgcacttagcacccaccttggtaaagaacctagaaaattacctgagaaaattaaatagttcacacacaattgtttcaggcctcaggtctctggcattttgtttaaggtgacctcagttttggcagctgcgtttattaaattctatgtacctgtcactccaccttgtaactttaaagaattacaaatgacaatgtttttaagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggtgagttattcagagatcagctgggggagctgagaactcctccagtatggttttaggttatacacaaacccttcagtctaacaacctttgttatttttccatattaccaaagtaatacatgttaattgcaggaggtttagaaaacataggtaagtaaaataaagaaaaatgctaacatcacccataatcccatatccaccgataggcccaattaaactctgttgtgtatcttttttttttttttttttttagacaaagtctatgcccaggctggagtgcagtggcgcgatcttggctcactgcagcctccacctcccaggttcaaacgattctcgtgccttagcctcccgagtagctggattacaggctcaagccaccatgcctgactaatgttttgtattttaaatagagacagggtttcgccattttggccaggctggttttgaactcctgacctcaagtgatccgcctgcctcggcctcccaaactgctgggattacaggagtgagccactgcacttggcttgttgtgtatcttttatgccttgtttattcttatatgtattcatatgtacttttaaaaactacagtaaggctatagtacatatactctttggtaacactgactatataatgatccatatcgtaaaataattaatcttccatgatattgtttttaatggctacataatattccatgtatcatagtttgttcagtcaatcccatttactaaataaatgtttctttatgtaaaaacattttacatagcatttacaataaccattttcataggtaaatctttggggatatccaaaattatattctttgacataatttagataacatgtctagtataaaattgctgagtcaagagtatgcttatttttcaggttttgaaagcatattcccaacctacccttcagaagggttacactcatttgacactgttgccaggagtgagtgagggtatatttctctacatagttcctaaccctagagattatctttttagtttacttttaaataactgatcatttgatatgtagtatacaaaaatgatatctcattgctgttttaactccatcttttggatcacgtgtgaggtggaatttttatttgtgtttgtcattgtttttgtgaattgtgtgtttgtgtccttagcctgcttttgcatcaggaggtccattttttcccccctgtctcatgagctctttaaatggtcaggatatttgctcattggctgtcttgtatgttgatgaagctttgtcccaggtaagcatttgccttcagaccttgtatatgaaggtcatttcaatggagagagatttttattttttatttactgaagctctttagtcttcctatatggtttctagctttttggaatcatgtttagaaaatctttttcatcccactccctggcaaatgatataaacgtttatttatacttgtttttgaatcctgtattttcttttattgcctttaaatttccaagctcctgcatttattggagctacagtgcaatagggttctaattttgttttctaacaaataaatagcttgtttcagtactgttgaaaagtccaactttctcctgatgatttgaaatgattcttttattataggctaaattattatacattaaatttgtttatggtctttctcttccgtttcttgatctgtatcctgttttgattcagtgtcatattgttttaagtattgaagttttaaaacatactttaatatattatttactaaaaatttaggtattgtattgcaaaaagttcacagacacacttactggttttatttttccaggtgaaacttaagtcccttttatttaaaaaagtcattaaattttgattgagattcatttaaattaatacattaaattgaggatgaattggatttaatatattaagtattcccaaagaatttggcatatttgctattcatatagtggtaacaaggcaggagatggaagagatggaagttgagaaatcaaatatttggccacagtaatcattctaggaaattggaggaaatatcttttgaaaaaaatgttaaaactcaagcattaaaacacgaattaattagtgacaaagggtaatattatccctcagagcagtataatgtgaattttattttattctaagggccaatggggacaagatggcctatttcttactctgaaggcacatcagtgaagggagcaggtgaaactgccaggcaggccttgaaatccaaggacactcctgccgtgcatctggccttggcgacagccagacaatttggtagcttcccaggtgctcggcaaccgaaaaaaacttgggatgaggaagagagctgatgtcagcagggcatcaggaacagatggatttctgctcttccaaggaagaggctgtgccgttggatgttttcttttggggggccacatactgggacctcctacagtacagaaacctcagtgggtggaggctgagccccacacccgtggaattcgacagcgccagtctcaggcaaggagagggaatgttgattccagggaggtggcggcccatgttcagagcatcatctttggagtctacagtgtatttgaaaatgtttctgtcaaggcgaaatgagctgacattgtgagacactggcactggtggcagaggggctgtgtagggggtcaggcaataccatttctcaccatttgggcaggaaagagtccacaggctaggaagggacatttcgtcttcatttaggaattatttagacacactttggagagttgagctaaggaaatgtagcttccaaggaggaatgaagctaccactgggtccgtatggagtcctgggaagccttagtttagagtaacggttcctacttctgttttgcaaggtcctctttagtatctttctgttttttttttaagggaggtgaggcacatgttgccatctctattttacaggtaattaagttgtccatgccctcacctggtgggtgaaacaactcaaaggtcagacttaggctgggctttacggtcttcttcaagcctagaaatggagcaacccaatctccatctttttacaagatcaatttggaaaaacccaaatataggaaaaatagttcattctagtgcagcatttcccagggatgttttctagagaccctgcaaccctcattgtacagagaactagagggcacctggtttgcagtaatctggcaaattactgccgattaaccggactgagatagcacactgtaatccaggaaaaactacctgccactacccgagccaggaaggctggcctgggctccaacgcaccagcagacccccaccccaccctgctgacaggatgtcccatgtgacactggcaggctttctttgacatcagagagggcagggaggcttagaaccttctagaaggatacggggagtagccttgagaagatcccacggctagaagctgagatgttttgttggtttatttctattgtaatttttactggttaacacttagccccatgagtgaatcctttcattgtttacaaagagattttattctcaagcttctaaggaaccctccgtgccagtttcccaaattaccagttttttagaaaggatctttatccccatctagtggtccaaatggtaagtacttcggtctgctagcctcagttgtattttctgtagtggtgaaagtgcagaccatagagaggaaaatacagaaaataggaagccttgctttttctttttcattctgatccaggattcagaggtcccggagcaaggaccttgctacaccatcatccacacacttttggtaaagaatgaaataaatagcactgttaacctggagtagtgttcccaaagaaccttttgtatttatgttttctattcaaggcaatgcattgatagaagttggtgaatccatgaagctaatggctgaggtgaaagactctcttgatattaatgtaaagcaaacttttattgatccacttcagttactacaagataaagatttaaaagagatcggggtaagtcttccagggtataaatatacctgttgctacataagatgatgtttatatttaaaatcactagaacgtttcagcagactgaaagcatcatcttatgatgcttgtgggtagggtaaaaatgactcagttctattttcctgggctcactgggaaagagtgccaggatccattagtcctatctgccctggagatgaagcaggataatgggagggaatgtaagccatgttctttcagctggaaattctgtatttagttgaagccagctctaagccaggctaaacaaagtaattacataactttatagtggatttcttattatcaaaatcgtaccatagttgcatgttttgatgcgttgccctggtggtcattattttccattacttctcaagaagatcaatacctagaaattgaatttttcatttggaaaactgttaaaaatggcgtgcatgggaattttcaggtacctggagataattgcatgccacttgcatggtggcatttttgtagatgtgcaaaaacagccccaagacttctaccccaccagtgacttccactctggaggtacaagcaccgtcttatggatatgtacagaagatgttcctccaggtgccttcagcatgatctcagcttggaggtcatttgagccttgggcatatcctgttttcccttcttcagacctattgattctcaaagtgtggtccctggaccagcaacatcagcatcacttgtgagaaatgcaaattcttgggccccatcccttatctcctgaatcagaaatcttatgggtgaagcccagcaagtctgtgttttataaagtcctccaggtgattctgatgcacgctaatgttcagaaaccactgttccagcccatcctttccagaactcgagggggaagtgtgaacccccactggtctagcctatgtgacagagatgaggctggtgggatgtgtgagcttgggtggccttccctgcttggaccgtgggccttgaggtggctccatattccaggggccagagaaggaactgatggatgtcagattattggttcttcctttgttcatttatttattcatccatcaactgtgtatagcctgctctgccctgctacagtggtggtgggcactggccatatgtggctaaacaagacctggtgcatgcccttgtgaagctcacaggtgtagggtagagagacaagtaaacagataccatgcactttgacagttgttggagagatgagcccagggacatgaaggagaagcacctctttcagcctggatgggtcagggaaggcttctcagaggaggagaagctggctaatgcagactgggagactggggtgggcaaaatatccagcacaagctgaccagagggccagggctgtgagagcaggcaggctcggggacctcggttgtgtgatatggccaggggatagggtgtgtaggggtgggggtgcaatgaagggaggaaaggctgagagtcacggaaagccctggatgcctgtccaggcaatgtatttagaatttctgctgaaagcaaagggtatgagggagaattcaggaagtttgagtgagaaatgaaagcatccattcaggagctccctaaacatcccattccccacctgcacaccccttggccccgacactcataccatcctcttcttccatctcaggggaaacatgtccctgttgctctcaagccagtcctcctctgggccgcagggtctgtcacctctcacctcctcagggccgttgtgacatccatcgtcctctctggtgtatcttcattctttccctttctgtctgttggcttcttcctgttaacatttacacacagcacagctgcccttgacccctggtgtcacatctcactccctcctgtccattctccagcccacagccagggcaccctttctgagctgcaaaccttcctggctgcccactgacagtggggtgaagatatagaccctcagcccttcacagcctggcccctcctttcctctgtggccttattgccaccccttccccacatgaactctgcccagcctcactgaattatttccagctccctggtgacgttttgctttgtgctttctcgctatttgctgtctttgtcctttcaccccttctcctggctgtcacctcacccctcagctcggatgtgctttcctttgggaagctgtttgttctttcgctagacttcgtggggtatcccttctgtgcctctgtgtcatgagcaccgttgcttaccttttgctcatgttgggcagtccattcctcggggtgagtgatcgtggtttgttccttgtagtcacaagcctcccacgtggtttgtgctcacacattattttatttttttaattttaatttttgtgggtacgtagtaggtgtatatgttggtggggtacaggagatgtttttgcaaattatttttgaatggttgattctagagaagtgacagtctgggttctggggatgccaaaacatctcccccaaatgcacagttgtaaaaccaaatgcctcctttgctgacatatagcaagttttatttcttcttgtgctgtcatcatggaggaaggtcatatgaaaagtcagcattgctcctccacctggccaaccacagacacatatgtggtcctgagtagtaagtgggtgaaatgtgtaaaacacacttattctgaaatgttgcagttctctatgcaacaaaatagttttctaaatgccatcttgttactcagctgctgtttgatacagaactgtaaatctaaacttaaattatgtggatgatggaaagttaagagtccaaggtttaggaagcctttcatagtctcagctatgctctgtgtcgctcagaaatcaggggtcaggggcctgttcatttgacatacggctgactttcaggtgttcatgtagaggtacagagggattagggaccagcccaaagtcacagagcaaagagagagatgtttctgactctctgggtcttgtgtgctcttttcactgagtcatggaagttagaagcagtgcttcctgctaaaatgaatagtgcgagctatccccatgcttcagtgggatgatcagtttctacatacactttcgatgcctggtatctgatttccgaggattatagccataaactctccagggacccctcccttgtcctgtatagctatcccactcagcactgtttctgacacggggtctctctgcttggacacaaactgtgatgggaaacctactgctacgcaaggcagcctgttccatgagtggacagttctaactgttatattttgttaaagcggttataatattgtttagaaattttactgtttcagaggttgtctgtgaatctctctcctttgcattcattaacagcgttttacgcaacttatttcttgattgtttgggaactttacggagatccgttaatattctaagggattgtagaagtttgtgattttatagtctactacttagtcaggagttgacaatagtaccaaaagaaatgttcctactgtgttttgtttggttaacctggttagaaattatctggacattaagaaggctgaagtgagggatcgtataaagaacgttggaaaataatatctgagcatggctactgcatcattacattccataaagacactcattcattctatcaccgatctgtccattcattcattcattccacaaatattcctggagcacctgaagtgaggggagcctccatcaggtgctgaggtgctcccaacagcagtgtaaggtgggttcctgccctctggaatctaggccgagaaaaagcaatgaccattttaatagaaataattttttgtgccaggttttgaatgtagcacctctctgagggactccattctctttttttagcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtaagtatttaaaccaaataggagattttaatgtaaatgaatgaaacattgaatatatgactatgatcggcatgttgaaaaactctaaagcaggagtgtccaatcttttggcttccctgggccacacataaaatacactaatactaataatagctgatgagcttaaaaaaaaaatcataattttttttttttttgagacgctgtctcgctctgtcaccaggctggagtgcagtgtctcggctcactacaacctccgtctccttggttcaagtgattctcatgcctcagccttctgagtagctaggattacagccacgcaccaccacactcggctaatttttgtatttttagtagagatagggtttcaccatgttggccaggagggtctcgatctcctgatctcatgatctgcctgcctgggcctctcaaagtgctgggattaaaggtgtgagccaccacccccgtccaatctcataatgttttaagaaagtttatgagtttgtgttgggccacattcagagccatcctgggccacatgtggcttgtgggccacaggttggacaaacttgctctaaagccttagttgttatgcaagtttctagaattttctcctatctcctgcctgagagattgattgcttcagacatccagcaagccctgactcacatctttttttggagacagggtctcactctgttgcccaggctggagtgcagtggcacgattgtgactcactgcagcctcgacctcccaggctcaagcgatcttcccacctcagcctcctggatagctgggatcacaggcatgccaccaaaccctgataattttttgtcaagatgggagtttcgccatgttgcccaggctgatcatgaacccttgggctcaagccacctacccgactcagcctcccaaagtgctgggattacaggtgtgagccaccacgccagcccctgactcaatatcttaaatcttgaggagtcctgtttatcccaggattgcttcagaggttgtctctgaagattgctaagtagactggcttttgtatgtgaggccataggatttatggtttcacaggagaatgaaaagtcgaggtcatgtagtaatttgccattttgctgagactgaaaagtacttggcaaggcagatggttaagggagaacagctctcttatctggggggcggacagccgctgtcatcccccagctctctggtgcctttacctgtcatagcccacattgaggacacaaaagcatgacccaaatttttcagctgttccatagtggtgcttgtgggctcgggaattgtgaaggtctcggatcttatccctcagaagtgccaatcttctattgtactgtggttcctgccatttgctttgatttgatttgtccaagtaaagtcaaatgaaatggaattaaggaggacggtgactcctgaccaggcaacacgcagctgggggtggcctccctgctcggccttgggtttaaggggccattggcactttgactgcctgagtggaagaggtgtcagccacctgcctccctccggagcccctgccctcagcctggcttcagcgatgccaggagctgtctcagccccagcattagtatgggacctaattgttaagtttttaaacctgtgggaacaagtcaggaggtttatttatcctcaagaccatgtcgtccttataacagtttatttaaaggtacactgaggtcttacatcctttgagtcaagtcaaaatgcattgagcaccctttatttaccatggtgatgtatggaggaattatgtccaatactaacaagacattcatcctggagaatttattctcccaactggaaatgccaatttgaaatttcccatgcccattaaaccactgaggcctgaaaagtacactctactgtgtttcttcttttaatttttttttttttttacattttttttgggaaataggaggaggtgtgacagtttggtatctctgtttttctttaaatgtataaatttcctcttgaaattgtccccaagcaacagcgattttgttttgtttcagattgccgtattgttttgaagtctttagaaaatgtatttgaagtgtgacatgtatcagatactccttgttgggccatatggaatgttgccctgctggctccaggcccattcatggcttaaactctgagattgtgtcttgtgtgtcagatgcgccgtctgacccatttgttccattcactgccttcatgcgggaaccacaatgatgggtttttgcgaagtgctccatgagggaagcctgtctgagccacgccggccttagcagttgacccaagagacctcagttttccccctcagtatcagtcaaaagtcaaaaaggatcccttcattataaaagctcaatcatttgtccatgttttgacagtaacacgtattctgcctgtcacaaatgggttaagtcctcccaccctgccccagcagaagtaagagctggttcctagcccaagctccgcaggggctctggtgctggccttgctccggcctggttgcagtgtttcctccaaggcttcctgtgggaaattgacctgcaggtgagtggaggtttcccctgttcagctctggggagtcagggctgctccctcagcctggatcctggggtcttcaccttcacaaggaggggttgtctggcttctacttctgccattgaggtgggaggagaccaacgttatgaaacggagatgggccgcccaggctgcccgggaactaggctcttccctccttcctgcttcctgcttcctgccatctgtagctgcaatggctgctaggtgtgctctggctgctgcttcttgcggtaatggtggtgatcgtgataatgataaagacagtggtgataatgatgatgacaatgacaagagctaccattcactgacaccccatgataaagaggctaagggggtgctgttgatggtccctgtcatggtgcatgtgcgtttaccttttctcctacccaggtttatagctgaggagactcagagatgattgtttaggcttcagaagcccatcttactctcttcttggggtcaacagcagttagatcagagggaatcacctgatccttttccatgtcagtgtgtctgtgccatagccaggtggtctgaccatcctctcctgttgaccagacaagctagagaaaaatctcctgctggtcactccttggacctgacatgccaatgccgatactgcctggtgcttggggataaacagagaatgtgactagttgggagaaagacaaaatgccaatacatggttgatggggcatacattgaacccttggccctgtgtttggcccatctccaacaaccaggccagagctggtggccttgtagcccatgggactctggtttcctgctccctgtgagtcacaacccgcacgtccaaccttggtcactcaacctcttgttgccatgttgcttcctttcctggtggggaagtcctgcatgaggagctgtgcttcgggatggctggggagggctggatttcctggcagaaactaaagatggctgggacctgttctaatcgccatgtcaaacacagtgggtctttgggtgctgctgcctgatggattggacggtgtttctacctgatctggtacctgctggagacaaggtgcacaaactgtcaaatgagtggctgcaagggaagcctggtggcaggcagcagaggccctgacacttcctccagacacaagtgggacatgcttctgttactgtggtgggaagtttggggatgtcagtcacagccattcaccctttgggttctgaccaatggaggaagtgacaaaaaagccggattggaatcaagggacatctctttaactgatgagaatgcttgaaaattgtaaaatacagacctcctggtcaactgtgctgaaggacatggcctgggcctaaagtcctgttggcactttcccctccttgcaccttcggtggatgacagccagctctaggggagagcccgcctgtcttaccacccagatacagcctgagacgctgaagctgggtgagtgggagccttgctggccccaaccctgcagagccagtgactgaggcagagcaacccatcctactaactagggagcacccccaacctcatccacaagaggaggaagaggagggcctggcgagaggacttagaagcattcgctccaaagagaaagtgaataagcagagaagcaaatgaagggaaatcctctgagatgggtgtgcttggtgctcttgtgctacctgtccatctctgtttggcactgacaattcaaagaccaaaatctcaccctgggggaagagctggtgccttctccagccctcatgtctcatcatcctggctaagacgcaataaaagcttcaccggggaatgcctcaaaagaaactgtttgccaaaactctgactgatgtgaggagaaccctgactggagttaacagacttggtctttcctgggtctccagatgtagtacttcctagggttttctggccaacaggccatttgcagggatttccagggtgtggttgttcactgtcctcacctctgcattctcccaactgagaaacaaacccagggagccacatgagatcacatgccagccccttgctcagagagcagggctctctagaaagccatgttggaaggggcagcttgggcctgggcccacagtagaagtccagtgagctattcctggcctgaagtctagaccttggagcccctgcagagagagcgggtgcagagaccacaaagccagatgacacacgatcttgtggccacttcacaaacccactttcttgagaaatccggagcccagagccaggcccctactgcctttccttgcagtgtctaggtaccctggttattagggccaagtgggtgccactcccgtaatctcaccagttagatgaatcaccaaaggaaggggaggtagagagacatgacatgctaactctaacattcctaagcagaagttttatctattttctcatctatttttggcagaactgggaatgggagaatgaagaagagtctccttcggccccacactgtagcctttggttgtcttgtgaatgggagctggattagagacattgagcatctcttcacatcttgcctgaggctgagcagtgtcgttattctataggcagtgatgcaagccaggaggtgttttggttctccaactttccagggatccaagaggggcagtcccatgactgatttctcaccaggccaagttgggcttggcagggtcctgagaagtaaccagggcagccctcctcttggaggaaagtgtgggaaagtcagcagactggttaccagccttcattgccgtatcttgggaacactatatcacccataggcttgttaacacactgtcacctcttctgtctttgcagagaagtttattcctcattattcctcacaacttactagtagcaaatgtaggtctttgacattagcagaaatcagagatattccatagaagatgcctatttcagtccagtgagtccaggcacctgcagtactggctgtcttggtatacattcaccagctacgggatcctccttccattcatgggttcccaagaccagtggaattactagattccagattcctgaggtctttccattggtctagagtagcattttccaaaatccattccatgggatgttagtgtgttttgcattaataatgtctctgtggtcacataagtttgggaaaccctgggttaaataaaactaaacagtttctttatcacaagacttttcagagtctttatttgacagtatgaaagattaatctctaagcggttcctaacagaaaatacagttggcagtttaccaaacttatttgaccgcagaattccgtcacattattatattattactaatgtttcaggactgtaatgtgtggaataagatgcattaggaagtattgaacttgtagaaagcatacccagcaaggcgtgagatacctgaattctgtttctgattttgtttctgctaagcctctgggaaaatcatttcacctgactggtatcaggcaaattaacaactgcatttgagaaattctttagaaggataaagtggagaataaaagtgtaagggattattatccatgttattaatttaattgccttactcaaactttctcagaaactctgaataaaggcttttgccccattggaaaagtcatctgtttatgaccagactgcaaaatacatgagaaattttccacagcttctctgaggaatccaaaaagagtagaggtctttgatatgatagagcaagaaattactggtattattacactgtaaattgaaggtgacctctatgggaaatgtgccttttcagttgtgaaagagaatggcttgtcgtcttttgaagatgtacacttctttattcctgcatgccaaacacacttgcagaccccaggcgtctggacaggcatcagctactcacatcacagttctctctctgtcctcgccatgggcttcagggtgtgctactctctgcttactcacccggctgctcaccaagtcccctggtaagggattgctaaagggtcagaggaggagggttcccagccctgctccttctaggcaccccagtttccatagtcctcttgcagagttggcctaagacagccttggttacagtatgcagtcctttgagccattcttcctttgggtacagcctaagccttttgcagttggctcacaaggccaggccaatggctcagatcttatgcaagtgtccctggggtttccataactcctagaaacttctagtatccttagtccattgtagttggggacatctattctctgtttccatccccaggactaagatactcccaacggccatatatgctgctaatcatccattggtttccagctatagagaggtttggaatgaaatgcatccacaggtgacacacgtgtgtcacttgtggattgtttattgtgtatagtctgccatgggagataaattgagttaattcctgttttggggttatccctcagaagagagtgaggagccctgggatacagccaaaccaacaatgaagtccccaggcccagccacgatgggcccattaccccctgagcttggttcttatgcgtctccaggcaacaactcccatcaccatgaatgggggtccctgggcagcactaatctcattgttaggtttttgcatagtttgaggatgggctaaagcagctctgtatcagtttcctattggggccataacaaatgaccacaaactgtagcttaaagcaacacacatttattgtcttccagcctagagtcctaaaatcaaggtgtgggtagggccatgtttgttctggaggctcttgaggaagaagctgcttctttgccttttccagcttctacaggccacctgcatttcttggctcattcttcgcttcctccctcttcacagccagcggcacagcatcttcacgtatctcattctgacctctgcttccattgtcatatcttctctgaccttggcactcctgtctcccccttaaaggacctcgtgattacattgagccattcagacgttccaaaataatctcttcatgttaagatccttaactcaatcataaccgcaaagtcccttttgctatgtaaagtaacatatttgcaggtttggggaattaatatttggacatctttgcaggttccatgattctgtctacctcaggccccctctggttttatggttctgtgtgtctcccaagttgcttcttcacagccctcacttcacacatttgtcaaccaccgaggcctgtgcctccttgacctctaacctacatggaagtcagcttgcattatgagtttctcacttcaaacatcagctgagtgtgagcccatctgtaggagctagagtgcttcactttcagaaaagggagtggattctctggaaatccagttccttggcgtatatcacgtgaacattttcatgggtgaggtcacactttgctctcaagatggcaccagcacagtgtcagcccaggtctcaacccggaagtggaattaaacctttcttcccaccccaggtgactttctctgattcaacagatggactgctgaaattccaacaatggaagaaatgttttaccttttggtcaggttttggctcttgctaagcctgagtttgttgctttatcttggttctgcctgtctaggtatttatttctaatcgtggttcaggaagctgaatgtacctgtgttggtccccatggtccccagcacacagctcaatgctcatgacctgggggacagctggaagcttcaattttctgaaatcaagaggaaaataatctatcgtagcacacctggtctttactgtcaacaagagacttacagcctagtagccagcccttcaggacttgtactgagcacctgctaggtgcaagcattgggcagtgctgccattgtttcccaaggtttaagggttttcaggattcatttccttcccaaagtcagccacccaatgagcagttacgaatgcatctctagattacatcaccttgtgttttagccacgacagggaggatagctggtaatccccttgcccccttcctgttccccaaccccaaatatgtttcaagaaatattaatttagctatctttcactatttctttaaaaattataaaatgcaagcattttttaaagtgggtaataagacagggcaaataaattttactaaaggcagagaggcatagcatagattttgccaagcacaccactctagcactgtaaggaagaaaaattgtttctgtaacaaattctactacgatcgtgctaggccatggccctggacttatttaaaagtacgtgtaaaagccaaagagatgaaatttaagaaatccttaggatttagtaggggccaggctgtctttgttttgtttattgggtttttggaaatttaaggctaggcttgttgcttttccagccacagagcatggtaaagtaaatgaaacccgacaggatttcattgttcggatgctgatcacagcttggcacacatggaattcaatgtgtctcttacatgcatattgagcccgtgtttaaaatagtataagtgagtaagaaaaatttaagtacaggcaactaaagaatgatttgcaactacaaatgaaagtagcttggatctttgaaggctaagtccatggttggttaggcagggtgagattgcataaatgaatcagcaggcagactttgccctaaagctgagtagaaaatgaagtatggaaatgatgcataggctttggggaagcctgggaagtgtaggattgattttgatttgtgtctttgtccagctctagagttgattggattcttgctgggggaggcccatcacctcaaccctctggagcttgcctctggggctttcagaaataagcttaattaatctctttcctgtagcagcccctcagacacgtgggggagcaggaaagctctcaggccttccttagattgcttttcctcaaattatacagccccatatcatccaggtttttccttatgagacacagctctaaaaaattcattgtaagttagtcattaatttcatgaatgtcttgatttgtgggaaacagagatgccagtgtctttatagttcattccctttagctctatgtttcagggaaaatatgttgagtggatagcaacaaaacgcatagaggggacagggaaatctttgccccagttcacatgttgctccctggccccctttcttatctgtttcatttacagttcttaactgtttaatgtacttaatgtcttgatttggcttagctagaaagtgcgtgttgagacacttgacaaagtaggcagttcttttgctaaatgttggcttcgtttgtaactggaagagctttatctctctgttttcagatccatgagctttatagcatagaaaatctgctgagaaaaatcatcatctaattggaaaaacaggcattttattgagttaaatcaaattcataatcacaaataaatttgaacatgtttttccagcatttatagctccataccatgacctgtatgattattatacagagctcctacatgaaattaaatgaaatggaccaaggcagacactggtcttccctgcaaagctaggtctttgctgctggtctcctctctctctggacattacacaggctcgggcctccatggaataattttgcacttctgctgcaggtagaacaagtcagccagttggctgtgttcatagaggcagcattagactatcacagacagtccacagagattctgcaggagctgcagagcaagctacagatgcggtaagcacctccacgtttcttacaagccaagggctgcggaggtaacatctattgaaatccatctgtctgtctctccatctctccatctcccccttcccctgcctcattctgttttgaattttctttcactggctttcatggttggatgtgggatgggactgagataataagtactggctttggccagtaggatagaactgggaaaagggacctggcagcttttctcctttttcttttcattaaatcccttttttttgtgacccgtgtttagggcaactaaccaagttgctctcccacctgggacatcaacccctacagaactaccctggcttcattgctgatttgatgagagtttaactccccattcacaaagggatggaaaacatccagagctatggaaaaaagtgagatgctgtatggaaaatatgtaaatatctgtaaaaaaaaaaaaaaaaaaaaaaggtagtgccttcacttcaccagtacgaatttcaggatatgttcataatattgactagtattgaaagagtcaaaatattgacaaatttcaggctgtgttcataatattgacaggtattgaaagagtcaaaaatatcttctgaacaatcaaagaaaggtttctgcattccttgtgaatttaatcatagatgtagtctatacttttctgaaaattagtaatattatatatagtctgcatggcaaccctgtttattaaaatattttaaattaggtttgataacagaaaattgttttacacaggattatggtaatgcataaatttggagggatttttacttaaatcaatgacgtagttacctagggaagacaaagatgtgttcagtccctgaagcatccacttctgcaggcagatagtttacctgttactgacaggagtgtattttcataattctatcataatctataagagtagagtgagggagaaggcagctcccatcactgggtgccgaccgcgtcccaggcacttgctggatgcctcagagacttgatgaagaaaattagtcttttgttttgttttgttttgttttgagatggagtcgtgctctgttgcccaggctggagtgcagtggcgccatcttggctcaccgtaacctctgctcactgcagcctccaccttccagtttcaagagattctcctgcctaagcctcccgagtagctgggattacaggcgcccaccaccatgcctggctaatttttgtatttttcgtagagatggggtttcaccatgttggccaggctgatctcgaactcctgacctcaggtgagcaccttggcctcccaaagtgctgggattacaggcatgagccaccatggctggcccaattagtcttcttcaagatgaatttcactcacaagctcaaatagggagttgaaaaactgcatttgtgatatcacctccatcacttcgggctactcaagagtcagtgtgtaaaaatcgtccctttcatgaccactggctgtaacctaagttcctgtgctcaacaaggcagagaggatgtgtgtttggaaagctttcaacatcagatgtctggctcatcttacgatgtgtgttacagaatatcagctgcatccagtgtccccagacgagaatacaagccaaggcctgtgaaaaggagttctagtgagctcaatggagtttccaccacctctgtagtgaagacgacaggtaagttgaccattctaatatgctaagtgtgcctttagtaaagcacttctagaaacacttatttactgcttgtttctgggtcagtgaatacacacagaccctggatatctttctttggttgtttggtaaattcccttttcccctaaacgtgccccttttttctgttccctggggaagaattctatcacttatataatgtagcatttagaaccttggccatagaaccattatggctacatcatcctttatttttttaactctttgaaaatattttcttaatttatttttaagttgaaattagcatttttgagcaactgctatatgctagatactatcttaagtgctgcatcgttattttttattaaacaagtgatgcaaatgtgtcttttagtaaaataatcaaacagaaaaaaattggtaaaataatcaaacagaaaaaaaaatttaatggtataagtcattctatagtctcttgtgatcacctacaccatcgcagttcgcttcctagatgtagccactgttaaaaaaatttggtataactattatcatatctattgaggtacataaatatacacataaacagcgttttggatttttttctgttttttctttttttcttttttgagacaaagtcttgctctgtcacccaggctgtagtgcaatggcatgaacatggctcggtgcagccttgacctcctgggctcaagcaatcctcctgcctcagccttccatgtagctggaactacaggtgtatgtgaccctgccaggcaaatttttttattttttgtagagacaaggtcttactttgttgcccaggctggcctgcaactcctgggctcaagcaatccttctgcctcggccttctgaagtgctgggattataggcatgagccactgtacccagccttttttctgttttttaaatgcgagattatactaggcatattgtttggcagtttgctttttaaaatgtatcactgtttcttcgagttatttccatatcatgcatatagatctatcccactgttttaacagcttcatagttttctattataccatttccctattggtggacgttaaggttttttccagttatttgctacagtgagtatcctttatcactgtgctggctacattactattaaagcatgaacacctgcttccccacacccatgccagtagacttccatttctgccaagcactcatgagaaaaaaatggtatccagtcttaatttgcattttcatgattattagtgagggtgaactttcttttctatattttaatttgtatttccttatgtctgaattgtctgtttatgtcatttatttgtgttttttgggagtagtttgctttgtcttattgttttataggagctctttccatatgaggatattaataatttttttcctagtttgtcatttatctttaaactttgtttttggagtgccttgtccctttgttgtttttgctgttgtttgctttgtttagttttgctttgagtatacagaagcttttattttgatgtagtcaaatgtgtctgtcttttgcttgtgactttacattttgtgccctgtcatgattacattttgtgccctgttgtgaaaagtcttcctatccctgaagttattcttctacagttttctactactttgaataatcttttcttaatatttagatctttatcataaggatttatttttctaaatgaaaagaaattcccaaactatctttcagagttgtgctaccatttcacatccccaccagcaatatattagtgatctagtttctccacatccctgccagcatttgctgttgtcactgttttttattttagccactttgataggtgtgtaattaatcttactgtgggtttaatttgcatttccttagtgactaatgatgttgaatatcttttcatgtgtttatttgccatctgtgtatcctctttggtgaaatgtttcttcatgtcttttgtccattttctaattggattgtttacatttttactgttgagtcttgagaatgcttgatttattctcaatacaggttctttctatatatgtgatttgcaaatatattctctcgctctgtagcttatcttttaatcctcttaatagggtctttcacagatcaaaatttttaattcttatgaagtccaatgtattcatgtttagttttatagattgtgtgaagtctaggaattctttgcctagccctaaataataaatattttcttttctttttcttttttttgagacagagtctcactctgtagcccaggctggagtagagtggtgcaatctcggctcactgcaacctccgcctcccaggttcaagcaattctcctgcctcagcctcctgagtagctgggactacagacacacaccacaatgcccagctaatttttgtatttttagtagagatggggtttcactgtgttggccaggctggtctcgaactcctgacctcaaatgatctggctgcctcagcctcccaaagtgctgggattacaggtgttgagctaccatacccggcctctcctatgttttttcttaagtccactttgtgttaattttgtataaatgtgagacttaagtcatttattttgcctatggatgtccaattgccctttcaaacacacattgctcatataagctgcacagtgtgaattttcttccaaccttatggctatccttaaaggtttttttttttcatttaaaaacaaaaattatcagagtaatatgtgtatgtagtttaaaaagaaaatggtaatatacgtatgtggttttaaaaaggcaaatgtagttacctctacctctgtgtgaaaacatgggcaggccccatgaattttctcattattaaaactacaaattatcagagtatatgtgtatacatttttttattttttattttatttatttttatttttttgagacaaagtcttgctctgtcacccaggctggagtgcagtggcgccatctcggctcactgcaagctccgcctcctgggttcaggccattctcctgcctcggccccccgagtagctgagactacaggcgcccgataccgtgcctggctaattttttgtatttttaatagggacggggtttcactgcggtgttgatctcctgaccttgtgatccgcccgccttggcctcccaaagtgctgggattacagctgtgagccaccaggccgggccatgtgtatacatttttaaaaaaaacatggtgcaagctttttcgtgagaaatggcagtttccccatcaactcctttcccagtgcttattttctgctctcagaggaaacactttcaactcttttacatatttatttggtacttaacttcatggtgcttgttttttactatttctttttttactctgattcttcagtttggataaatgtattgatttcctgatatggaagataatggcttagcttcctaacccttggtcttccatagacttctccctcccttcacccttccaatttacttataatcactatttttgttaaataaatattcattgtgtaatcatcacttccatcatgtgggactcttaaaatgcactcctccccttttttccctgctcttattttaaattgcctactcacggatgaaaatgtgagcaggctgcatgacttttctgactactcttgggtcacataagttctccagtcacttgaatgtgtaagtgcaggctcgtgcagtagtcaaaatgctaagacccatgtcatggtcaaagctataatcttgatttaaagtttggctttcactcctccccaagctctggcctgttgccgtgggaacattggtgtcagggaagaggttgtatttggctttttctctttccccatctaccccttctgttcttaagtccccagagaatgtattttaagctcgctgaggaatcttttaaaagttcttctctcttgatttggtgtgaaatgaaaagatcacaacacatcctgcctcctccacactctctccaacatttttctaaaaatcctttttaatctccatcttctgacctatttatgccatagatgtaggctgggattaaaagttataaaactggctaccctcatctcttctgtttttgtttgtttccaaatcctgcataagttgtcttctgcacatcggtttaataaaaaagaacaaacaaaaaaaaaacagttctggggcctcatccaaaacttccatttttacatcgcctaacacttatttacaatgtcatgagcacagaaataatattcacagcagtatcacatagtgcactatcattgcatttctattcttgtacaattgttgtcttgatgactgtagctttataagttttgaggtcaggccctgttagtcctctaactttggtcttcattttaaaagttgtttgactattctagttactttgcattttcatgtgagttttagagatcaaattttcaatgtttcaaaaaaatcctgctcagatttttatttggattgggttgaatctataactcaatttaagaggaattgatagcttaacaatattgagtgttccaggcttgaacacaatctattgtatttcccatttatttaggtcttcttgaatttctctcagcagtgtttcactatttttagaatatatacaggtcttttaaattttttcatcaatctctaagtattttatatctttatgcaattgcaaacagcattttaataaaatttccatttctgaatttttgtttctagcattcataatattccattgatttttgtatattgatcttgtatcctgccatgttgctaaatttacatcttaggtctagtagttttttaatagattccatagtttttctacatagatgttcacgtcatctataaatgaagacagttttactcaatatctgcatgcctttgtttttcttgccttttttcacttgctagaacatgctgagtacaaagggttagagtggacatccttgctttgtctctgattttaggggagaagcattcaatacttcataattaaggatgattttagctgtagatttttcatagattttttttttttctttttgagacagggtcttgccctgttgcccaggctggagtgcagtggcgcagtcgcagcttgttgcaacctcaacctgccaggctcaaaagatcctcccacgttagcctcccacatagctgggactataggcacacaccaccaagcctggctaatttttgtatctttcgtagagatgaggattcaccctgttgcctaagctggtcatgaacttctgggctcaagctattcgcctgcttcggccttccaaagtgttgggattacaggcatgagccactaggcctggccttcatagattttaaaaatcagattgagagagttcccttctagtcataaatagtttgaagagagttttaatgagaaacagtctttgaattttgtcagatgcctttttttggtatctgttgagatgatcgtttattttttagttttagtttgttaatatggtgaattacattgttagttaaatcaaccttgcatccctaggataaactctttgtgggaaagtttttttaaattaattttaaattttagaatagttttagacttacagaaaagttgtgacgatagcacagggcattcccatatactcctccactcttctatattaacattttattagtatggcacatttactttatataatgaacatatatttatattagctaaagtccacacttcattcacatttccttagtttttacctgctgttctttttctgttctaggatcctatccagaatagcacgttgcatttagtcctcacatctccttcggcctctcttgctgtggcagcttctaagactttctttgtttttaatgaacttgacagttttggggagtactgtttacatattttgtagaatgtcccccagttgagatttgtctgatgtctttacatggttagactggagttatgagtttctgggaagaagatcacagaggtaaagtgccattctcatcccatcacctaccatctcacatcagtcagaatggctggtattaaaaagtcaaaaaatcatagatggctggcaaggctgcagagtaatgagacagcttatacactgctggtggcaatgtagattagttcagccactgtggaaggaagtttggcaatttctcagacaacttaaagcagaactatcatttgacccagcattcccgttaccgcatatatacccaaaggaatataaatcattctaccataaagacacatacacgtgtatgttcatcgcagcactattcacaatagcaaaggcgtggaatcaaactaaatgcccatcggtggcagactggataaagaaaacgtactacatatattccatgggacagtacacggccataaaaaagaatgagatcatgtcctttgcagcaacatgggtggagctggagaccatgatcctaagtgaactaactcaggaacagaaaaccaaatactgcatgttctcacttgtaagtgggagctaaacattgagtacacatggacacaaagaagggaataatagccagtggggcctgcttgagggtggaggttgggaggagggtgagaattgaaaaactacctaccctgtactatgcttgatcacctgagtgacgaaataatctgcacaccaaatccctgtgatacactgtttactcatataaaaaacctgtgcatgtacccctgaacctaaaagttaaaaaaaaaaaaaaagaatatgccctatcaacaagattaatcactgctgatattgatcttggtctgctggctgaggcagtatttgtcagctctctgtaaagttactccttgtttttttttttttttcctgcatgaaggctttaagctataaattcaacgtctttatagatagaaggcaattgaggttatctgtttcttcctgagtgaactttagaagttggtgtctttcaaggaatttatccctttcatctaagttgtcaaatttattgcataaagttgttcataatattctgttattatccttttaagatatatagaatttgtagtgatttacttctctcaatcattttagaaattggtaatttttgtctttttcttttcttaatcattttagctatagatttatcaattttattgatcttaaagagccagctctctgtctcattgagttttctctgttgtcattgagtcctttcgccttttccgatatatgtgtttagcgctatcaatttccccctaagtaccacttgagcaccatctcatgcattttgatgtgttgagttttccctttcatcctctttaaaattgtttctaattttacttttgataacctctttaactcttggtttcttctgaaatgtgttatatcatttccacatatgtggatatttttcagatctctttctgttttagatacctatttaattccattttttatcaaataagatactttgtatgaatcatacccttttaaattttttgaagcttgcttgatgggccagaatatgatccatcttggtaaatgatctgtgtacacttgaaaagaatgtgtattctattcttattgggtagggtgctttataaatgtcaattaggtcaaattatttaatagagttcttcaagtcttccatattcttgctgattttttggtctatgttttcctattaattttgtggcagagggtattaaaatctctgattatagttatggatttgtctatttctcctggcaattgtatccagaagtatgggaagttggctacattcccttccgtattcctcattcgcattgacccttttagtctgattacttgcattttttaaaacacggaaagtgtgtttttgtttgtttgtttgtttgttttaagatacggggttttgccatgttgctcaggctggtctccaactcctgggctcaacattccttccacctcggcctccaaagtgctaggattataggcgtgagccactgcacccccactgatttatttatttattttttttactatcttaaatatccttctcctctattccctttctttttgcccttgtaaacaactactagaggttgaaactttttgtccttcctcggacaaaaagtcttttcctccttgctctctgtacctctgtttttttattctgccctctgaggacatttcaccttcttactttattctttgatccagttatttatttagcatatctattgaatttcttactccaattgtattagttctctattgatgctgcaatgaaataccacaaactgtgtggtctaaaataacacaatgtatgatctattttatagttctggaggtcagaagtcctcaaatcaaggtgttcacattccacacagggtggaatctgttttcttgcctctcctgccttctagaggctgcctgcagtccttgcctcattgccccttgctccagcttcccagctggtggcatgacatcttcagatctccctgcctccattgtcagatctccttctctgacttggattctcctgcttccgccttataaggacccttgtgattatactgagcctacccacataaacccagggtaacctccccatctcaaaatctgtaacttaatcacatcgtcacattccctttcgctgtgtaaggtaacatagctataggttctggggattaggaagtggacatctttgaggctattgctctgcctaccatgatagtgttcaaatttacatttttaaaaaattttacaagtaactagacctttcatattcctctgagaatattaattatactttttatttttatatttatttagttttattttattttattataattattattatttttttttgagatggagtttcgctcttgtcacccaggctggagtgcaatggtacgatctcggctcactgcaacctccgcctcccaggttcaagcgattctcctgcctcagccttccgagtacttgggattacaggtgcctgccaccgtacctggctaatttttgtatttttagtagagacggggtttcaccatgttggccaggctggttgcgaactcctgacctcgtgatctgcccaactcggcctcccgaagtgctgggattataggcgtgagccaccacgcctggcccttaattatgctttttaaaaagtctccacttaattcttatctccttgagtgtttgttgggatctggagtctactttatgaagttgtttctcatacattgatgattcttggctctgtgcacaactttttatttgagagtgcttatgaggttgcctcctgtggttaaggggaaataagggatgttctgttgagtgcagtggactggtttctgtttttctgattgtttctatcatccatggcactgccctgactttctgtttcagatgcccacactcactcagtaccccttcctgaaggcagttgccagggctcctggcactggtacaaacccaggatgagtggactcacctggctgctcttttctcagaaagccagccagctttcaggatccacttacactgagttttgagcgcccttagacttcactgtcacagcattccgctttgggagccattttgaacctcatttcctccatctgctgctttccatcttccaggcattcttgtattcctcataatttctggtctaccagcagtatttagtctcattttccaacattatttgcaaccttaaaaagtcctattttgtaagtgatagggatttggtacatgaaaggaaggctgcagtcctgtacttcattgtgccatattaatggaaatttcccttaagacattcaatgccacttatctcactggttgcatctttgcttctccccaggatggctttaggtgctgaatggatagagacaaagaatcttgactcatatgatgagaaaatattctttttttcaattctcttatattcattccaatttcaaggagataagctacagttttgtgctggagtatttttaatgttcaattttaacagagaggagaggcctccggttaaaagtcatttacagactacagaatgtatcttttggatgtaataaaattgtctattttccattgtaattattttcatgcttacagtctctatagcatgtggtactagttttcagtttacattttttgatgtaatgtttcagtgaaagttatttgaataaaattgattttataaaaaacgtatcaagaggatacttaggtacaattctctgaagactattttttgttgtttgtttttaaagattttgatgaagcagatatattttcaaggtagaattcattggtgccaattttctatctcttcttatttacttatttttttgcgctttatatttctgtagttgggggagaatttcaacttcccatgtgaagcactccccctttcctttctttatttttttggtattctaatttttttccttaggtttttgaggaacaggtggtatttggttacataagtaagctgtttagtggtgatatttgtgagatttcagtgcacccatcagccgagcagtgtacactgaacccaatttgtagccttttatcccttaccccttccaccctttctctcaagtccccaaagtccattgtatcattcttatgtctttgcatcctcatagcttagctcccacttatgggtgagaacacatgatgtttggttttccattcctgagtttcttcacttagaataatagtctccaattccacccaggttgctgcagatgccattagttcatttctttttatggttgagtagtattctaccacatatatataccacagtttttttatccactcattgatgggcatttgggctggtcccatatttttgcaattgcaaattttgctgctataaacatgcgtgtgcaagtatcttttttgtataatgacttctttttcctctgggtagatacccagtagtgggattgctggatcaatggtagttccacttttagttctttaaggaatctccacacagttttccatagtggttgtactagtttacattcttaccagcagtgtagaaatgttcccttttcacccatccacgccaacatctattttttttaatattttgattattgccattcttgcaggggtaagttgatatcgcattgtggttttgatttgcatttcccggatcattagtgatgttgagcatttttttcatgtttgttggccatttgtatatcttcttttgagaattgtctattcatgtcgttagcccacttttagatgggattgtttgttttttttcttgctaagttgtttgagttccttgtagattctggatattagtcctttgtcagatgtatagattgtgaagattttctcccactctgtgggttgtctgtacactctgactgttccttttgctctgcaaaagctctttagtttaattaagtcccagctatttatctttatttttgttccatttgcttttgggttcttggtcatgaagtctttgcctaagccaatgtctagaagagtttttccaatgttatcttctagaatttttatagtttcaggtcttagatttaagtccttgatccacgttgagttgatttttgtataaggtgagagatgaggatccagtttcattctcctacacatagcttgccaattatcccaacaccatttgttgaatagggtgtcctttccccactttatgctttcgtttgctttgtcgaagatcagttggctgtacgtatttggctttatttctgggttctctgttctgttccattggtctatgtgcctatttttataacagtaccatgctgttttggtgactgtggccttatagtatagtttgaaatcaggtaatgtgatgcctccagatttgttctttttggttagttttgctttggctatgtgggctcttttttggtttcatatgaattttaggattgttttttctagttttgtgaagaatgatggtggtattttgatgatgggaattgcactgaatttgtagactgcttttggcagtatggttatcttcacaatattgattctgcccatccaagagcatgggatgtgtttccatttgtttgtgacatctgtgatttctttcagcagtattttgtagttttccttgtagaggtcttttacctttttggttaggtatatttctaagtttttgttttgcagctattataaaaggggttgagttcttgatttgattctcagcttggtctctgttggtatatagcagagctactgatttatgtacattaattttgtatcctgaaactttgctgaattcatttatcagttctaggagctttttggaggagtctttagggttctagggttttctaggtatacaattatatcatcagcaaacagtgacagtttgacttcctctataccgatttggatgccctttatttctttctcttgtctgattgctttggctagaacttccagtactatattgaatagaagtggtgagagtgggcatccttgtcttgttccagttctcagcggaaatgctttcaacttttgtcgattcagtattatgttggctgtgggtttttcatagatggtttttattacattgaggtatgtcccttgtatgccgattttgctgagggttttaatcacgaagggatgctggattctgcaaatgctttttctgtgtctattgagatgatcgtgtaatttttgtttttaattctgtttatgtggtgtatcacatatattgacttgcgtatgttaaaccatccctgcatccctggtataaaacccacttgattgtggtggattatctttttgatatgctattggattcatttagctagtatattgtcaaggatttttgcatctatgttcatcagggatattggtctgtagttttcttttttttctatgtcccttcctggttttggtattaaggtgatactgacttcatagaatgatttagggaggattccctctttctgtatcttgtagaatagtgtcaataggattggtaccgattcttctttgaatgtctgatagaattcagctgtgaatccatgtggtcctggacttttttttttttggtaattttaaaattaccatttcagtcttgctgcttgttattggtctgttcagggtttctctgaagactttttatattgtattatgctaacactagtttgtgtctcaaaaaaaaaaaaaacaaaacataaaaccgaaatgcagtaaaataggatttcctcactcctgccacagtccagggagaatattccaagaagataggtggttctaatgcatagagtctctcaggggtctaggctgatggcagctctgccatcttcatcatatggcttcctagttgttgccactccagccagcaggaaggggagaaagaacaaacatttaggttagatatttcctcttacacccgcaaggtggaaatgacacacacattccagggatgagcgctcaaacagccacacctagtagcaaagcaacttgggaagtacaacctctagctaggcagctgctatccagttgtaatggcatcttagtttgtttgggctgctgtaacaaaataccttagactgggtagcttttacttacagtctggaggctgagatgtctaaaatcaaggtgccagcagaactggtgcctggtagaggccattcctcatagatgacaccttctagctgtgtcctcacatggcagaaggggcaaacaagctcccacaggtcccttttataagggcacaaatcctactcatgacctaattacccccaagtcactaattctcatgacctaatcacctcctaaaggtcccagcccttaatactattgcattggagattaagtttcaacagatgagttttgggggaacacacacattcaggccatagcaaataggaaatacactgcatgtaccagtccataacaatgatggactcctgctgggcagaaatttcaaggaccccctaccctggcagtgaagaaagtgtcttgattagaccctggttctgctctctggattttggatcagggagactcttttgtcttttattctgtgggctcctagatttgctctctgagaaatgtgtcttccaagaccacattgtaagtgggctttggagggctaccttctttgacatctgtacttattgctgctcagggaccttgtgggttccttacagtttagtagacacagatgtcttcaggctaggcttatgcttcttttcacaacttgatttccttttttttttgagatagtcttgccctgttgcccaggctggagtgcagtggtgggatctcggcccactgcaacctccgcttcccaggttcaagcaattcttgtgcctcactctcctaagtagctgagattataggcatgcaccaccacgcctggccaatttttgtatttttagtagagatggggcttcaccatgttggccaggctggtcttgaactcctgaccttgagtgatccacctgcctcagcctcccaaactgctgtcaccacactggccacaacttgatttcttaaaaaacgtaatgagcttctgatctatatacctccaggcagttccatgtgcctgtaaacacattcaaagttctttcttagatatagctcttaagactttcatttctttccttccttgtcttacccatgcttcgctttcttaacttacagaggctaccttgagaccacctgaaacagcagatttgagtaggaaggtgacacctttcgttgcgtctttgccacacagctgagttcctttagtttagggaggtctctgagaatgatttggaagagcaatctgcttatcttgttttctttggggtacagaaacagtttgcttttccaatgcattaggaaccaacctctgctctttcttttatctttgcttgtagactgggcaacttttgtctttcttatagtaacttgctacacacaccaaggtttagctaacatccaaccttctggctttattcaccttctttctttagagctactggtatatggtctgctttaagagttattataggcaaaaagtttttcaaatgttttgccataatctaacaggtcactgggtttcagcccggtgcggtggcttacgcctgtaatcccagcactttgggaggccgaggcgggtggatcacctgagttcaggagtttgagaccagcctgaccaacatggagaaaccccatctctactaaaaatacaaaattagctgggcatggtggcgcatgcctgtaatcctagctacttgggaggctgaggcaggagaatcccttgaaacccgggaggcagaggttgcggtgaggttgtggtgagccgagatcgcaccattgcactccaggctgggcaacaagagtgaaactctgtctaaaaagaaaaaaaaaaagaagctaggtataagcaaattaactaaaaattttgacagtgagttcaacctcagcctccctccttcaatgccagtatattatatttgaggaaatgagaacccaggaccccagggctcagtccttgccccactgtctctatctttccagcttgcacccgagtagttcttagagacaggacctcaggtcaagctcccaagacaccattctctcatttgccaccaaagagaactcaactttcctttgatttgagctcacagactggcagtgtagagagtgttaagccttataaaaatgaaaaggtatttgaattaaagtatcccttaaggtcatagggacctagcctttgagggccaacagtatgccaggagttattatttggtgctttgtagacatagacataactcatttcatcctcataaccgtactccaaggaagtgataataaaaaaaagtaacacataataagataatgacaatagcaactacacttattggctacttactatgggttagatattgtataaatactttgtatacatctctagtactatttttagtccccattttacagatgagtaagtagaggctctgagaggttaagtgagatcttctcaagatcacagagccaggaagtagcagagctgggtactttaccttatagatatttcatgttatatcattaagaaggaatactaggggaatgttatgaaatggccaagagcattgggaatgatttatttccaagattcatgattacagggaatctgtggtcagcaggtggttgcacagggagcccactaaatgcatctgacttggaagggaaaaacagaggacagtgaggtctttggcttcctcattgaggccacgcatgtcagtgctttgtcccctctttcttggccagtagctgggtccctagacagattaagttcctagaagggcgatgtacagagatcacagacgtgcagaagctggcttttaagaaggctcagtgtcccatattctccactgcagcaaactctactgtgtgccactgtgtgtcttttgcctgtgcctgtcccaggctgcttcttctaagtttccctcggtagtagcttcaagttcccgtctcacacacccagcattgggcttccttgatttgtgggtggaatttgccagtgtaaagggggtcctgtactgtttgtttctgaggcacagtttcaaaagaaaatgacatttatagcctgcattaatgggaaattactttccattaggattctgaatgatttgcacataatgtttataaagtgaaggaaaaatgtcaagcatttcactaacaaatgaaagcaaagctcatgagactctgccagaaatgaattccaagaacattttcttcatcatttcttctttctaaagaaaaaaagagagagatgaaagaacataagtcaattaagcagaatgcatcgtgggactgagatggaatctttgataatatcattgctaggtagttaagagaatgaataaagtgagccaaaatggagaaaggggagaatcacatcttgaaatgacagattgcagacaaaatccaactctaggtcctggctgggagaaacgagtgcctgtccaagcccgcgagtgtggggtcatgctgtttcatcagtgtaagctgcccctctgtccccaaagagaaaaggaggccaggaaacatccttgagttgaaacatgtgcctgtgtagctcccagaaaaccactgatgttgaagaaaatagtgtaggaatttgtgacccatgctcaagtatcttccccacttgtggggaatttgtatcaggtcccaggttgtcacctcctgaattatatatttaaagactagaggacaaagtgtattttatcaactcattttttatgaagtttttttttttcttgctgaaactcttaaaaggggtaccactttgtgtaatcacaactaagggttaatatgccccaaactgggacctgctttaaacatataggaggctgaaattagttaacaaatatgtattccaaatgtgtgctacaggcacatcagagtgagttgaaataaatctcccaaatggcttgtattaagaccttctaattctctaggtataaaagagacttttataaatttcttcacacttctaaggcagcttggaaataatttctagagcctaaatccttcccctcattggcacaaaatgtctaggattacattagaaaataaacatttattcaaaagtgaaatgtgaagtttgaaaattaaagatgaacactttgcaaatagaaatatatgcaatttttttaacctacatttccgaagaggaaattaaaatttcacagaacagtgacaatggtgattgttcggtcagcaggttgtttcttacatttctcttctttccttcctcctcttttcttctattccccttctccactaatagccttccccccagatccatttctatatattataagtagtgcttcagagtcagagttattgacaagagagaaataaataaggaaacaagagtcccatgttatagttcagattctggaacttcttagttgtatgagttggggtgagtttcttagcacctctagaccgatttgaacttgttcctagaggaagtgattggacttaatacattccaaggtactttctagctctaaattctgtggctgtagtagttgtcttttgtgagtacttagcattcttaataatttgaaatgtggacaggttgaacatttaaatattttctatattttaaaaaatgttttaaaaattaaagtgtgaaatatgattattattgttgatcagtagccattggtgcggtgaacaggaagagtctctctcttattttccaatttgaaggaagatttagagagggaagttttcctcactgcagggaatggttttctgtaattattctgaacagtctgtaaaaagagttttgaaaagccgtaagacataaattctaacttagttgtgggaattttgactttgctgaaatgatctcaagtgctgcatattttcaaatcttaacatatactctataatgatacatttgatccataagctaaaatgtaaaataccatcatctaaatattaatttatgtacttgttttaaaaaatacggtagaagtcagttgtttcctgggattacaaaccaggcaacagtgatgttgcaccatccagaggactctgagtccatatgaatgacagcccctagagttgtccagtggatgtggctgcaagtgcaaacttgaatgccagattttaggaatgagagacataggaaaagtgtaagaaaatagtgcaaggctggtgataaatggctgactctaagcttccaagtcaggatcatgacagagggaggtgtgtcttcaacaactagaaaacacttgttctttctgaagggggtggccgatagtctacggcaagcgccccttgcctgagaatgtgagcccatcatagctagcctttctgatttttcaagagaagccagaaaccctatgtttatgtgacatctcctgacttttagatgttggcaactaatccacattgtaaaaaagcaaggagcaggccagacgaggtatcatctgcaagctgatcactatgccaatggccagaaagccaactctaattaaggcagctgtttgcatttccattttccagaactcagagtggcaaataataataataataataataataataataataataatacaaacaacaacaacaaaaaaaacaacccacacacattggacctggttgcaatagaggggtcacctgccagaaagtttattttgataaataaatggcccgcaggttttgaggtatctgcaaaagtcatcacaatagacaagtcattgttttgtaaggtgggggagggcaaaactttattagttaaacccatctaatataacccgagtaaattgaggaagattggcattaaggttaacataaatcacacatgcttatttttacagatttcaatgattaagcttgagttccattgacaagtaatttcaataaatcacatctcctgtggataaatacagggctgttatttctagaaagacagcagttcattgacttttactagattttacttagtagtgcacaacttaaccctcatagaccaacacttcaaatttccagataaggaaatcaggacccaaagatgacctaatccatagcaaagatgcagggatctgaagcttctgtccagtgcgctcttacccatggacaaaaacaatatgttagagatgttgaactagatagtgtctgtggtatctatcagcattagacaccagtgttgtatctgggtcagatagagagaaagtatgtgcttcaaatgaattctgctataagaatttgagattataaatgggaaaaaagaaacttttgaagggagtttaaaccagatatgcttgtttgaactcagaggagatggtatctcacagattgagcacggtgcctggctccatgctcctggctccatgctttcaaacactcggtgagagtttgaaaatgaattggaaccagaaataaacctgaaagttccaaattgggtttctacccgccccccactccccccgcccgcccatggtaggagatgaactgtctagtctgatggtgcaggtacagtcaaacctcagggtaacctgggttctgggatcgaagcttctaggagacttggggtcccattcctgactggggcatggactcccctcatcaatggttaccttcctctctgttcatcagctgctctacaagtggtgtaagtaataagggaacatgtttggatttcctgacttcaggccaggaagtgagcggaatataagcccacccagcccaaaggggtgttaacctgccttgctggaaagtgggctttggagtcagagggaagcccagatcctggctcagttcatacctttgggtctcaatttcgtcatctgacgagtgcggattctcattgctacctcacaggattattctaaggattaaattagatcttgtgaattaggggtgctgggaaagggactcggtacagagtaggagcccacaatgcagcgctgttaatgttacataatcggttatctgatttcccagcctacagcagactggaaccagcagattaggaaggcccaagggactgcttcgggaaggccattgacagcaggaaaaagtgacaggtcgcagccagactacaagggaggcaagagaaaaactataaaaagcaggaacaaaaacactcaaaagacacagcagtctgggggatttactaaaagacaaagagccctactcaggtcagtagcttctgggagactccataccttgtaccccaacagggacttatgttgacagcgttgtatgaattacttctctctccatcccctttgccccttgaaataactatgggggtggggtcatagtttgcctttcagtggggatgctctgaccgaatgcttccaggtcatgaagttcccaaagtcaaggccagcaaaggagcaagcacagtgggctccttcggtggtctgaaaagaacccaagttccacaaaagagctgtgagttttagtgcaacagagagaaggatgccccttgcgccactgaccactctttccaccttcacctcccttaaagtcagggttagagatggagccctggagaacaggcttccagatcctggcatgtgggagagagagagagagaaaatgagaaggccaggctgcagacacgccagtcccttctgatgccatctctactctggtgtctaatccaccacctggagtgggcactgtttttaactgaagcctgagctgctcactttgaagctggaactcaggctgaagaaggcaggacagagactaagtgcctggaagttatccctcaagtgcgacaggcaaggctaggtgggacctggacagaccttcctggggatctgcgtaggatttaggtagagaatgctcttagagagccttcaaaggcctgggagcatcctgaggtatgctgagctgaggacccaaaggctcattccaagcccagctgatgggccaccccattgaatgggattggctcagaaatggtgtgggagaaggctgggcgtggtagctcatgcctgtaattccatcactttgagaggccaaagcaggaggatcacttaagccctgaagtttgagaccagcctgggcaacatagtgagaccccacctctatagaaaataccaaaattatccgggcatgatggtgcctgtagtcccaggtactcaggaggctaaggtggaaggattgcttgagcccaggaggtcaaggctgcaggccaatagcagggcactgtactgcagctcgaggaacagagcaagacagtctcaaaaaagaaaaaaggaaaaggaaaagagaaaagaaagaaaaagaaaaagagtggggataagaccacaaactaacaattttcagggggtatattgcatagggatcaagaacgtggactctctacctggcccgaggtcaagtctcagtgttgtggcttaattgtgttaaatttgtgtcctcaatttctccatccctcacattgggggaaatagtggtacctactcataggatttctctgggaattaaatccataaatccactaatatctctgagacacttaaaatattgtcctggcacatggtaaacactaacacctgagagttattatttcgtccctgtagctgagtagggctgaggaattgtaggattggaccgcctctaccttaataaaatgtgctcagcatttctgcatatgcaagtaaccctttgcagcagcagggacttcagccaaaaaatatatatatatatatataatatgtatgtgtgtgtgtataaatgtatgtgtgtgtgtctatatatatatatagagacaaaataagtggagttgggggaggggcaccgcaaataatgttcctgctgttaaaataagagggactgaaccatattaatgccaagggggaagttcagtttatttcaggggggacgtggttttcctacctcctactgtgttactgatacagtacttactgaccagccgtcttaaactcttgtggtagggtctctctctctctctctctctttctctttttcctaatggtgtggaacagagcttgaataataaatatttaacagggacactcccttttctctgttaaaataatctttgtttcaatactttaacaaggaagactgtgttttcccacctctgctctcacgtttcgttgaagccaggtctcaggagtaagagaaaatcaacacaaggccacttggggagggcagtgctggctgaagccgtctcactggacagcccagggtcaggggtttcagccgcctgttcaaggacaccgagatccacagcagccacctgggagctcctacacaactatgcccagcgattccaggtgccagctactgaatgtgagagagcaaggaggtggaggtggatgaggaactgccagctgcaggaccacaggggcaaggggaaggggttgtcaacagggatgggacgctgggtaggatcagtcttttcttacgagacgttttcagctgaggtgctggcttctgatggtgggaaaccaagcattcaggtcccttggagaggcttatatctaacagttggaaagcctccattgaggaaatccagcccattctgcctggactttggggctccatccatggtgacttttgtgtcaagggaaaattcacacactgtccctcaggcgggcagcaacttaatttctctttagctgaactgaacttgcttgcaagcctctatgtagaccaatggcggaaacaacttaatcttttttccatttctgttgttgaccaaaaaaaaaaaaaagctttaaaatcttttttccatttcttctaatggtggaaaaaagcataatcttgccatttcaaggtagctcagtctcttccaatagaaagcatagactatccgtttatgacttaggcgattccagatttaaacacagtcaattcagagtagaaattccctatcagggctgttggtttttcttgaaggttctctcctccccctggtccagtcctaagatgttgcctagatgtgaggggggtttacagaacatcatggtggcaggtagggaggctcacttccacagctgaggtgactcgtcacaggaggcctggggcctgggccaggatctgtgctgacatctgtggcttaggcctccctctctgggttgctgaatctctgtatttggagccgtgtgtcactgcccccaggcagcctctggcctcagtggcccctcagcacttcctgctggggacttgagggaatttgttcacagttcacagggagcgaccagccttcaggccccatctgtacttagtgacaccacatggtttccactgggctccagcccccgtgttagtccagagaactttgacagctgccttctcccgggatttctgtggaaagtggagtctaagacccccttccccagggtggcatccaaggagcatttcaattttcttgctcaccctcttctcactgcaggccccttccctgcttccctgcctccagaaagagcttgtatctcttctctggatggcaggaaacagctcctccctctccatggcttgtaatcaaaatgctaggctctgagttcttcaagctctagttcttggaacccagaagtttctctctctctctcgctcttaaatcttataaaagcctacctggctctagcatgaaagcctaaaagccttggctttcacaatgtttcacaactgaaatggtattatttgggaatttaaaagctaaacattgactgctttgttcatgtctgggttccaccctcctcctcaagtaagggaggcaagccccagctccttgggttgagggccccaggcaacagaaatgacccagaatgaaaaatgcattgatacttcagaatatcgtccggctgcatgtataattcagggcagccagtctgagctctggttggggtggatttaccaactgcctacttagcaagtgccaattgctcttagtgttgtagccagcccagtggtggctggagggccaggtgcacttgtactgcctgagtcagggagttcttgaacagggtctttctactcagtggtctctggagagatgccctgccttgggtttaggtgctgatggagtgtgatatgagtgctggtctctttccagctctcagaatatcaaagtgggcaatgtggcagtggttccttgccaagaatgaatgacatgagaagtgagtaatgcagcttttccatgatttgttctgtgtgtgtgtgcagcaagaacccaggtttacacatggaggtggtggcctggtttacacatggaggtggtgcatacacttggacaaatgtatgcttgccactaagcattttggtcattgcaggtggcttatagagtaaatgggagggaaatatataaatctatctatctatctatctatctatctatctatctatctatctatctatctatcattagccctgtaatcagtgtgtcagcctatgaaatgtcttggcaacccttagtggtgtcatagatcatgtacgaggtgacatggagcaaggtagctgatggcctagggtctggagccctcctgtttctggctcagccagtagccctggggccaggccattatgacctctcagaggcattgatggcttctcttggaaaaggagaggactcatggaggactgccaaattccattctagcattaacattctgtgttcaaggaaatgcttcccgagactaccatgtggtttggcacctgaccccttctctgttaaaaactagtctagtagtgggagaaatgctaaaagaataataattatttttataatccacattaaaacagttatacattaataaagtagactttgactcacagctcaggttgcccttggttttcagtgctcagcccccacctgcccacccatatacacactccatgacccaaggaaaatgaaaagttctgtattgtaagccctctattccccatgctttgtttgaaatcattgaatgttgttctgttcaaattcaaaatagtgaactaatccccaatatttacagccttccaccccctagctttcatcattatgacaagaggaatacacagacttaggcaggggtggggtctgtcacggaaggagctgtctagaggctagaaacatcatgtagatcatagaggttatattgcaggtgggttcagagtttcaaagtcacgacccagtacaggagctgcctccctgaagaggaagaagagctcccctaccattacccccttctctttcctcgccagctgagtctctttaacctttaacgcttccttaggggaaggagaggggaggatcatttcactggtggttgtcaacctaccctggacataggaaggacctgagaaacaaaaaatactgatgccgggttcaccctgggcagtgggctgtttagtgtgccaccaagttgagaaccactgccataggaaggcaacaggaagccaccttggtacaacctggggagctccgctgatgaaggctccttagagtgccctgttccttagagatataggcgctactccatgaatttcaagctgtctaaacaactataatataatccttctcacaacaggaatctccattgccccaactcttgtcttcctcctcccataatgctgtcacctctctacccctccccaggacaaaggggcatctcatttggccagccacagaaataccccaacgtacctattctctttacttggacctagaagacttagtggagaaagaacataatctctagcagaacttgttcaattctcacttgaagtctagagggaggaaaaagtcttataacagaaaaaggaaataaaaatggaaatcatcaaataggatggcaaaagtcacttattaagaaaaaaaaaaactcctaagattaatcttattaatactcaaagaaaaaaagtatgaactagtcaaaattgaagtgagatttttgtgagagaaatgtgtcatattaatactgaaatatacctagttaaatgaattcatgagaatagcaaggaaatattgaaatagaagggtaatgactatgaactagttttactagttattaacattttatttatttatttatttttgagatggagtctcactctgtcacccaggctggagtgtagtggtgtgatctcagctcactgcaacctccgcctcccaggttcaagtgatcctcctgcctcagcctcttgagtagctgggattacagacatgcgctaccatgcctggctaacttttgtatttttagagatggggtttcaccatgttggccagggtggtctcaaactcctggcctcaagtgaactgcccgccttggcctcccagagtgctgggattacaggtgtgagccaccacacccggcctgttaacatttattataaagccacagtatttaaaatgatatggtactgttaccaaaatgagtcagtgggacaaaatagaaaaaatccaaaaatagatctaagtcccatgatgattaaatatatgataaagataaaggcaatacttgaaatcactggagaaaatatggattatttaagtatgttgttatgactgcataagcattattaaatataatagatatttacctcattttgccaaaatccaaatagattataaaagttctgatgtgaaaaaaattaaataaaaatactagaataaaatttagttgagtctttatataggactgtggagaataaaccatgaatagaaagtttgattagtttgactgcttatactcttcaatttgtgcattcatgccaaaacaaaatagaaacccctttccctgccccactgccagcacaaacttcaaaaacaaaatgagaaaaaaaaagaacagatgataagttgggaataatgtttgtaccagaaatgacagataaagggtaaatatgtgtagtataaagggacttctaaacatcttaagaaaaatagtgatattaggttggtgcaaaagtaattgcaggttttgccactaaaagtaatggtaaaaattgtgattgctttttttttttttttttttgagatggagtcttgctctgtcccccaggctggagtgcggtggcgcgatcttggctcactgcaacctccgccttccgggttcacgccattctcctgcctcagcctctccaagtagctgggactacaggtgcccgccaccacgcccggctaatttttttgtatttttagtagagacagggtttcactgtgttctcgatctcctgaactcgtgatccgcccgcctcagcctcccaaagtgctgggattacaagcgtgagccactgcgcctggccactgtgattgcttttgcaccaacctaatagaaaaataaattgacactaaatgtcagatattttagaaagaattcatgttctatgaccatgaaatccttttcttggaatttatcctcagaaattaatagtgcacatttgtagatatttatgtataagctctttttcccaaagaattgtctataaaagccaagggggaataaaagagacaacagaaagaaatgaagaaaaaggaagagaaatcgagaaaaacagggagggagaaggaagaaaagaatgaaggaaggaaggaaaagaagagatgaaaagaagagaaggaaggaaaagaaagaagaaccgtaaatgtccaacaataggagattagttgaagaaatgttacattgtgagagctgacagctagtcagtaactaaaattgaaagatattcaccctagcttgtacaagaagaatcttttatgaaaacaactatatgtaaatatatgcacaaatataatcatgaagacatctggaatctgaaagctagcccagttatctctggggtaatggtttacagctctgacttttctttctccactttgcatacatgtattttttgtttacaattagcatgattttgttttgaaaaaaatgtttttgatgttattctgggactagatgtcagtaaatattcttgtctgtaaattctggtctgtaaatattcttgcctttcttgtcctggtttctctcctcccggcccttgtcctgcccattaactaggaagatcttgctgaccaccaaggtcctccctactaccctctccccagagctcctgaaccatgagtgatacacacttcatatttgttctttaaaagatttttggccatgcacagtggatcacgcctgtaatccccacactttgggaggttgaggtgagcagatcacttaaggccaggagttcgagaccagactggccaatatggtgaaaccccacctgtactaaaaatacaaaattagctgggcgtggtggcgcatgcctgtagtcccagctgcttgggaggctgaggcacgaaaatttcttgaacctgggaggcagaggttacagtaagccaggatcgcaccattgcactccagcctgggcaacagagcaagactctgtctcaaaaatagataaataaataaataaaagtttctcgtgtattttctaatccccacaaagaaactgtaagctcccagagagaaggaggtgggcctgtgattcctctgtcgctcccttagggctccaggtggagctgactggctgcttttgggagatgggctgggcacgacttctctgcctgggagtattgaaaagatagactctgggctcatggggttggcgcaggcagctgggagagctgaggcagccagagaccacaaacggcaccgtgagctgggtggagctggccttgtgggaaggaagcaaggcctgctgttaagggtctctctgagcttttccacatttccaatttcccatggataatccatcatgttcatctgtactttttgtctccatatcatgtggacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggc

SEQ ID NO: 194 - DNA, 1291 bp, Homo sapiens
atgagcttcaccactcgctctaccttctccaccaactactggtccctgggctctgtccaggctcccagctatggcgcctggctggtcagcagcgtggccagcgtctatgcaggcaccgagggctctggttcctggatcttcgtgtcccgctccaccagcttccagggctgcatggggtctgggggcctggccgcggggatggctggggatctggcaggaatgggaagcatccagaatgagaaggagaccatacaaagcctgaatgaccgcctggcctcctacctggacagagcgaggagcctggagaccgagaaccggaagctggagagcaaaatccagaagcacttggagaagaagggacccagatcagagactggaggcattacttcaagaccatcgaggacctgagggctcagatctttgcaaatactgtggacaacgcccgtatctttctgtagatcgacaatgcccgtcttgctgctgatgactttagagtcaagtatgagacagaactgcccatgcactagtctgtggagagcgacatacatgggcttcgcaaagtgattgatgacaccaatgtccctcagctgtagctggagacagagatcgaagctctcaaggaggagctgctcttcatgaagaagaaccatgaagaggaagtaaaaggcctacaagaccagattgccagctctgggttgactgtggaggtagatgcccccaaatctcaggaccttgccaagatcgtggcagacatccaggctcaatatgatgagctggctcggaagaaacgacaggagctggacaagtactggtctcagcagattgaggagagcaccacagtggtcaccatgcagtccactgaggttggaactgctgagatgacaatcacggagttgagacgtacgtccagtccttggagatcaacctggactccttgagaaatctgaaggccagcttgtagaacagcctcagggaggtggaggccttctatgccctgtagatggagcagctcaatgggatcctgctgcacctggagtcagaggtggcacaaatccgggcagagggacagtgccaggcctaggagtaggacgccctggtgaacgttaaggtcaagctggaggctaagatcaccacctactgccgcctgctggaagatggcgaggacttcagtcttggtgatgccctggacagcagcaactccatgcaaaccatccaaaagaccaccacctgccagataatggatggcaaagtggtgtctgagaccaatgacaccaaagttctgagacattaa

SEQ ID NO: 195 - DNA, 5380 bp, Homo sapiens
attgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgaggtaacagtgcctgaggcgcgggaggaggcgggggcaggaggtgatgggaacgaaggtgcgggtagaagtgagaatccgggcaacagagaagggctataatcacgaaggccctggagctggagggctgtgcagtctgcagacctcagtggggtgggggtgggggccaaaaccataaagcaagaacattcctggggacctgccaagaccagctctggccctacgagttctagctgcactggctgcccaaatccctaattgtaaagccaggaactatccttttcgctcccctccatctccttccctcatttcctcaattcctctccttaggcttttcccctcctccatccgtagtgttgtgtcatgggaggaaagaactgagcagatctgaagaaactgagctggccagccagaggcaactagaactattaggaaagcatagactctgaaagtccctaaagagattaccaaggtttaccctctttctaattccccctcctcccgcggagcaaagccagacatggccaactggacagctcccaggtaactgcactaggtctaggcgtctgtgccctccctccatggttactgggtaccccctccccagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtagggggtccccagagtctccctgatgatccaattcatcttcccagtaatcccagctcctttcccctaaagacctctcactttcccccaagactctgagccccccatacttaagttttctgaaccagtgaaatcaatgcacaattgaagtctggggagggattccctctccttaaccatctctccctcttaactccccttaggtatttgctgacctgtttgaccctgtgatccaagagcgacacaatggatatgacccccggacaatgaagcacaccacggatctagatgccagtaaagtgagttcaaatatcccacttctgatttgcattgcctgtgtacaacactctgtatctccaaccccttcaccttatttcctgactcatggtcattatacagctgagcttttaatcttaatgtaaggaaagaatcatatcttaaggggcagcatatatggagatggaaggatagataagaatgaccatgacccaaggtgggtggtttggggaaaggtctgcaatgcccccttcaattccagtgctttcccaaagggcctcttcttccaatgcatgcaggaagaatgcacaaagagtcctctaatgcctaaggaaggtctctcctttcccaggggccctcagttcccaccgtgtttctgtgacttacattcatttcccttatctcccagatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgtgagggccttaagagggtgctggttggtgggagcagatggggaaggctgggccagatgagacatgggctctgaaaggcccaggggccaccatgaagattcttaacccaagtcccgttactcttcccaggaccactttctgtttgataagcctgtgtccccgttgctgactgcagcaggaatggctcgagactggccagatgctcgtggaatttggtatgaagctgctcattacctcttttgtcttcatgccctcataaatgctttttttccctctatctctcccaattcttgccttgcctcttgatcactgtccctctccggccctcaggcacaacaatgagaagagcttcctgatctgggtgaatgaggaggatcatacacgggtgatctccatggagaagggtggtaacatgaagagagtgtttgaaagattctgccgaggcctcaaagaggttagagaagactatgtaggggagctaggtgggaggacataaggaaaaccaaagagtagcataaatagattatgtaatttaccaaccaacccaggacatgtcttatagtaaaaaggactatctaggactcactccaggactaaaggtgtaaaccagctgggaccatactgggaaaaccaggacatgtggtcacactaagattaggaaaagaaagagtgtcaggaatcttaggaagtgaacaaggctgttgacagagagtgcaaagaaggaataaatgagatggcacgtcagtgcctgggatgtgtgcagtgggatggtgaggtgtgcagataaggaaaacattcgagcttagattgatgttggcggggagaggttgctgtgttcatgactctaatataaccacccagttctgagacaaggtaggccttgactctggattctatcattcttgttaaagtatcgggtctaggctttaagttgagagttcggagagagactggggaaggtggaggatagaatggttcaagttctagaatatgtggctctagatgagaggttgaactgaatcatcaatcctacatggattgggtctccgtattcaagtctacattagaaatccccataaactcaattcaattcttactgtatgttctcaaacatacagttctattttaggtttgcaaagaaaaagagctcctcttttagattctgagaagtttctactatttttggcaagtaatagataacatattctgactatgagtgggtagggaagtacctttaaattatatgcctcagtttcctcatctgtaaaattgggataatgagattttctacattttaggttgttgtggggattaagtgaaatacaggtaaagtacttggtccacagtaagtgcttaataagtgttaaagtgttagctgcaatattattctggatggaagagtttccccccatgttcagcatgtaagatatcccctatggcatggttccttctgaactataaagaggatccctttactcatgttgggttgtggtctttgtgaccatcattctgctagatcccttgtctcttgaactctaatagtcatcttcatgactacatggttaagtgaagccaaacgccttccccccgccccctattcctatgaatctggcttttctgctctgttttcatctttctctgcattcacacaggtgctccgttcacagctaacagaatgttatcttacctcttcctggcaaagcttacaccttcatcttctgtctgaagggacccttctaagctctaggctcattagcaaagcaaagataatcgatgcatgcagacctcattgaataatcagtcatctctcagttcagtttaccacctctgttcatttccctagatcatccttaatacaccactccttcgagttttcttcttccacataagatattttttcacaatctcattattatgcacatcataattttgcatcatgcatgcatgaaaacaataacaaacctttttcatttaaaaaaagaccaatgtcattcattcacagccaagtttctgttctagacatatttctagtgttcttgtgggtctagctaagggagggtccagggttaatgaaatatccctgatttttcgttaacaaaacctttgtggactcaggtggagagacttatccaagaacgtggctgggagttcatgtggaatgagcgtttgggatacatcttgacctgtccatctaacctgggcactggacttcgggcaggagtgcacatcaaactgcccctgctaagcaaagtaaaggagttgtggggttacagaggggtgtgagtaaggaagggtgggttgtggatggggagggagtggaccctttggaaaggagccaaacatgttgtggctaaagggtcagaggacaggccaggcacagtggctcatgcctctaatcccaacacttgggaggccaaggcaggcagattacttgagcccaggagttcaagaccagcctgggcaacctggtgaaaccccatctctactacaaatacaaaagttagctgggtgtagtggaggctgaggtgagaggatcacttaagcctgggaagtcgaggcttcagtgagctgtgatcactccagcctgggtgacagagagagaccctgtctaaaaaaaattaaaaaagaaaaaagaaaaaaggaaaaaaaaagttcaggagacagagctctgagcaggttcagggctctttcaggtaggactagtctctgcctctattgaccctgctcccaatccctatctcctctctaggatagccgcttcccaaagatcctggagaacctaagactccaaaaacgtggtactggaggagtggacactgctgctacaggcggtgtctttgatatttctaatttggaccgactaggcaaatcagaggtgagatcctaagggattaggacaaggagaggtataggtctgcgagggccgaaatatggcagtgagtgagcctccgggatgtaagataatctgaaatgaaattcaggttgagtggggaggcaattggaaatgagcaggcaagtcagtcagtgataaagaaaaactcagactgtaggaagcagatcaaagattagtgtcccttaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 196 - DNA, 1440 bp, Homo sapiens
ttgcctggttccacatgcactttaacctgctttatttaggcttttgaaagcaacctaaatagctaacattgactaaataagtgcagtatacctggtctgtgtgacattttgcaggtattaaaaagtgaacattctgaacccttttagcaatatggcaaatacttctgatgtgatgtatgcatataaatatgatcgaaagcaaatatcccaaaaggttgatggcagttatgtcaggttagtagcacaatagtttcttttctcattttctcacatttttagtaatgtgtgttgcctatattaaaaaacaaatattaaaaagtagtagcatgtattagatcagagcatgggctcagactgcctgtgtcatctcttattagatgtatgaccagggacaagttattgaccttttgtttctaagtctctaagtttatcctgtaaaatgaagataattgtagtaactacctaataacatgattgtaaggattaaattatttagaacactatttgttacttggaaaatatgcaatcataagctattttgttgttattgttattttactaccaaagcttattgtttcagagcccctaggtgaccaggcaaaatggcagttccttccagctggtcctcagatgggcacatctattagtaagtttcatttctgtatttggatctttattcatccttattatgaattccccaatactgaggtttctaggaacctacctgccattggctgaagggttgcttctgaattctttcccagaggcagtgacaaaaatcaaacatccgatgtgttctttacctttcagtaagctcagcctccctgcttgtgtcacatctctaaacatacgtacatgcgtgattgaaactgtctattgaaagcaatattacattaacattatcaatactgaattagagaaaatatctatcaatgtcaccaattccacctgtctcttgatgtatgactttttacctgacaggctaaataacaatagaaagttctttttaaaaaatagaagagttgctatgcagggacttttttggaattaagtgccccagagaacctagaaatgtgctttaaaactttttgtttcacctggcagatccaaaaaaaatttggaagcttttggttgaattccctcattacttgaagttgttttatgaaaattgaatatatatatctgttaggttaccaagacttatggttagctatcttaatggctagtgatataagaccttgtaacaaaccctaccaatggaactgacaggattttaccagggaggatattgcagtacctgtaagaggaagggatacaaattggcacttcatacatttgtgagaacaattgcctttaatgtgtctatttggttttcataatattgcaggcctctgctcttgtaagaagttagctgcagaacccacatgtgaatccttgtag

SEQ ID NO: 197 - DNA, 15835 bp, Homo sapiens
atggccgcgcccagtgatggattcaagcctcgtgaacgaagcggtggggagcaggcacaggactgggatgctctgccacccaagcggccccgactaggggcaggaaacaagatcggaggccgtagtttattgtggtgctggaaggggccagtctggagacagtcaaggtagtttgggacaggaagtggagaagtagtaaatcgataggttgggactccgtggaatgagggtaaggggcccagagtggatgtagaaagcagagaggggtgaaagatgcttttgaaggaaggtggcttggttggctttgcgttgatttgacatcctgggatggtagtactcatttttctttctttttttttttttttttgagacggagtctcgctctgtcgcccaggctggagtgcagttgcgcgacctcggctcactgcaacttctgcctcccgccttcaaacagttctcctgactcagcctctggagtagctgggactacaggcaggtgccaccacgcccggctaatttttttgtatttttagttcagatggggtttcaccatgttggccacgctggtctcgaactcctgacctcaagtgatccgcccgcctcggcctcccaaagtgttgggattagaggcgtgagccactgtgcccggccggtagtactcattttcttttgctctttttgaatgatattctagccctcacctccttgcttccaattggtttaccaggattctgtggtatagtagtctaagcagaggaaagtttcgttccttgcgtcattccacatcccaagacaagttactgggcagatgagaaacgtagttatgtagcctagtctgcccacactttttgtaagggcttcgtgtttcaattcattagtatccatagtcacctctctctaatatccacctatgatacactgtccagacctggttattatttaaaacttttacatctgcatttttatctatcattcatctctttccccacatgtaatagaaccagcagttctctatcttaaagccttgggcagtgttcttcctcctcctttctcttacccgttagaactaattgaataggcccagaagaaatcgcattggtttagaagtcaggccaggattttaatcttcgttctaaatacacttttttttttttttttttttgagatggagtctcagtctctaccaggctggagtgcagtggcacgatcttggctcactgcagcctccgcctcccgggttcaatcgattctcctgcctcagcctccagagtagctgggattacaggcctgcgcctgtaatctattaaaagaatagaaaacatgattatatcctactaatgggttgaaactgtattattcattcaagaaggtttttttcttctataactaagggtgtctcatggacttagttcttggtcatttgttctttgtgctctctgtgacattacttcaactattcaatttcaaaatctacatcccttttttcgcagactttttggagccatatatctcaagaatgttgctagacatatacattccagtgatacataaaaacttaaccttccaaaacttgtatttgtatataacagtttgtttttagactttttactgaccaccctaatgctccttgggactccaaattgcaacttggaattatttcttttagctgctacagatgtagtccacttctttaacatcaaacttctgatgtcttttccagtgtacagagagttgttaggatagtgtctgtcagtcattcccatcctgccctgcttactccagaattatttttggctttgtgcttgatacattaggattctgtggtttacaaagcagcttcatatataatcactgccctttagtgtctcagctcccaattttcctcaaaatttcctttcttcgtttccactttttcttttttgtttcttttttgagatagggtcttgctctgttgcctgggcaacagagtgcagtggtgtgatggttcactgcagcctctacttccctggctcaagcagtcctcccacctcatcctcctgagtaactgggactgccagcaaatggcactgcgcctggctaatttttttttttttttttgtgagacagggtcccaccgtgttgcccaggccggtctcaaattcctgggctcaagtgatccttccacctcggcctcctaaagtgttgggatcacaggcataagccaccacacctggctactttgtcttgattccatctgtacctttgctcatgccagtctttcttttttcttttttttgagacagggtcttgctggagtgcagtggtacagtcttggctcactgcaatctctgtctcctgggctcaagccatcctcccaccttagcctcccaagtagctaggactacaggcatgtgccaccatgcccagctaatttttgtatttttagtagagatggggtttcgccatgttgcccaggctggtcttgaactcctgaccttaagtgatttgcctgccttggcctcccagagtgctgggattacagccgtgagccactgcatctgcccccatgcccgtcttaaaactgggaataacccctcttccttttacttctgagagttttctttgattaaactgcctcctgcatcattagttttcacatttcttttttttgagatggagtctcgctctgttgcccgggctggagtgcagtggcgctgcaagctccgcctcctgggttcatgccattctcctgcctctgcctcccaagtagctgggactacaggcgcctgccaccatgcccggctaattttttatatttttagtagagatggggtttcaccgtgttagccacgatggtctcaatctcctgaccttgtgatctgcccgcctcggcctcccaaagtgctgggattacaggcgtgagccaccacgcccggccttcacatttcttgttcagatttgcagctcttcacttagtgcatgtttggtgtacgcaaactgagggtggtgactcgatattttgcacagtacctacttactgctcctgtaataaacacagcattcagccttgctaactactaactcctgcctagttccaggatgtctcattggccttgcctaacagccacaggttttttaattaaatccagtgtattagtagataatgtgaagtcacaggttgtgcccttcctcctgtttccctctcagaccattcactggggagtgcaaataaggctgcacagtaatcccccgaagggcttgctgggctccacccccagtgttcctggtttagtaggtctagggtgggcctgagaatttgcctaacaagtttccaggtgcagctgctgctggtagtttggggaccacacttgaagaaccacggggctaggtaacagaagcttatgctgttctctcgtcatgttccctgttcttcaggtagggaagacatatgagctactcaactgtgacaagcacaagtctatattgttgaagaatggacgggaccctggggaagcgcggccagatatcacccaccaggtaactccagggacagtgctcacaaccctttgagcctctgtatggaagggttggcagctgagtgctgcctctcttcagccttaaccatgtctcggtttctgctttgctcagagtttgctgatgctgatggatagtcccctgaaccgagctggcttgctacaggtttatatccatacacagaagaatgttctgattgaagtgaatccccagacccgaattcccagaacctttgaccgcttttgtggcctcatgggtaagaagccttagaacaaagttagaatgaacttgtcagtagggaagaagggaggaagaggaaaagggagaactaaatgtggatttttaagcgagaaaatgggagaacaacatgattaataccaggacaaggactgttattatttttctatgtttgtggaaactccactcctgttcttgcagtagcttcctggctgagtgaaagagggagtctgaacccatcactgtacagctagccatatgcttggcaactgtttgttcctaacatttcaggagtccagtctagatataaagcacacagggaactcatcttatccatggggttttccttgttcgatgactggacagaaggactgtggtctccatctagctctgaactcttttttcccccttctagttcaacttttacacaagctcagtgttcgagcagctgatggcccccagaagcttttgaaggtgaggtattgaaacctgttagttgaaggctggttctgggaatgtttctggggctgacttttctctcttttttactttaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtaaggtctgggctcaaccctgaaattcttggtagagctgaacttagtatagaattcccagagcagtaggcattttaacaatgcttacaatgagctagaagacacatgacagttccacaccctgccccagggcacatcctttgagggctgctgccataattggaagtcacagttaggaccttcttcatcctttgtagggatttgatattcaacagcacagctgaaatactagctcagccatagttttcctgccctaaagaagggctgaaacagctactgagtgacagagttggctgacaaaactgttcttttcttaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccagctacttgggaggctgaggcaggaaaatcacttgaacccaggaggtggaggttgcggtgagctgagatcccgccactgcattccagcgtgggtgacaaagcaagacgccttctccaaaaaaaagtttcccctttggccccaaatgaagacttggctggcagcagaggcacagctggaagcatcgatcttccacctccctggcttttccattctctgctctggggcaaaggagtgctgtgaaaagggagacgagtagtttctgcaccagtcccgcacaggccacctgcaagacaagaggagtttggaaggctggttagttactcctgtaattcctggtctatagcccttccagatgtttcctagcatgcctcaataagtcacagtagtcattgcccatactgtgttccttagtagccaggctaatccttggaattcaccccagatttctaatactattgtttttttccagtctgttgctctattctgtaacctggtggtagttttagtttagctgtattaacttaccagggaaatggattattccatcttctttaacttctctttccttggcaccattgctttgtgaatataaggcaatatgaatagtaggctcaggaagaagatgtggccaaggaaatagatggatttatacacctgtggagagagaggccactaaggtagacaggcctggagtgtcctttgcaacctttgaggttgcagtgagtccctcccagtctcacaagcaggccttcacttgccttaagccatttgtcccacgtgaagaggcagaaggcagtcatggagtaacccatgaagagccagtggatggtctgttgcaccaaatagtagaagggctggaggacagtaatggcggccagcttgctcagggtggggctctcttgaatgagcctggcagcctggggagggaggaggagctcatcagcatcttgtcccttatattccccttcacccccaccctggaggcctacctgtctttccacaataacaatgaggaattccatctggaagcagaccaggtatcctgagtgcaggccgtgccagagggccaggaatagcaacgagagaccctgagagagttctttatttccaaggaacttgagtcgtttgaagatgtagctggagaaaagggtgggtggggcgaccctcaaactgactggtccttgcatcccgccacctgcctctgggtcctcaccctgaggattggattggagtgctggtgggttcccacgtgtagcccccagagggtacaggaggcagtgctgactgattacttttagagatggaaagcagacccaaggcggagctggagaccgtgtgcgcacgagccacttggttcagcagcagtgactgaggctgatgctgagatcagtggtgaaccagacactctactcaagctgcccacactctagtggtggggacaaacaagtaaagctgttgataaacagggcagtggaggacataagtccattggcagagctggagtaacacccaggtcttaacgcacttttatatcttgcctttttttcaaatatgacagtaatggtttttttgggaggggggtataggtgggggtcaaagtcagtgtgagcgacagggggttctgcccagatgggaaagacgcataggggtgacatggtacacccctgccctccaatctgggaagacagtggaaggaaggaaccagggtccaggctccccaccagcagctcaccgggccacccaggcgttggtgttgatgttgaatgaggcaatggtgccagtgaagcgggggtttgtttcaaagagccacaccttcatgttggcacaggcatcccactttgccttgcccttttcttcaaagccattgaagcccaggcccgtcaaaatgcatactccttcctgagagggaatagctcagttagggctcttgccactccccatactggcccccatggcttgtctaaataggaccttgtttcaacttttctacttactgtgaccagccaacaggtgacatatttgtacagcacaaacttgccccagatcagcatgtacatgcagcggaaccagaaggggtggttcttgagggaagaaagcacagtgcattagggatatcacatgactaggcagtttctctcagcactcttccttttcacacttgtggctggctacttcatacctgcctgagtcctgctgccagatgccctcaatagtctggcctgattgccttcacaataggcagagaggaataagcagagggcctggagaatattcattcgcctttcccttggagagcctcaagggcagcactgtatttaacttctctactgtttgccttcgttggcaaagtgtttggaatgagcatttggaatgttaagtacagaggggcccatattggattttaatttaaggagagaaacctgcccagaattactgaactgttttcaagcctttcagctgggcaggagcaaaagccagcacttccccccttcccttggtttctgaattccctagaagtgcccaaatgtatcagtcaagagaagaaaataggatggagaatcagaagctgctgtgctctgaggggtcacgtggatgtgataaggcaagctaggagcggctcctagagaaggcaacgggtgctaaatgtgcacctggcacagccctgtgcccgcgaaggttgttcagtgctggctgatgaacatgtcccagcacggctggcattgacaactcacagatctagagcaaaaccaacatgcacttgtagatgatatttcctacttctctgctatctgtagggatccttgcctgtccattttctagctctggtgcagtcatgctgctgctgctttagtagacactcacgtcatagtcttcagtgaggagatagtcttctgtgatgtgggggctgagcagtgtgtagcccactaggtagaaaaggcccagactcaggcgcttgagagcaggaatgatgctggaaaggaacgagtgaagttcctggtcacagagagcagagactattcccttcaccctctgaccttcagttatggagaggagtgtttaggggtgtggttgtctacctggaatgggatgagaagctctgctgcccaaagtgtttcctgtttcagggaaagatttctatggctggctatgaggaatggggactgcaaacctcttaagagttgtaggaaagtcagggcagcagacagtggaccagtcttgtgtttacccctcagggatgctactgatctcaaggtcttgccaggtctcacaatctccattgggactgaaaacccagtggaggtaagataataaaaataaccactttgaatctgctccttcatttcttggttgaattgatgctgaaacacaggatggacaagttctcagtgaaggaattcttctggcaattaaactttttttttttttttttttttaccattttaatttttattttctagagtcagggccttgctctgccactccggctagagtacagaggcatagtcattgctcgctgtggccttgaactcctgggctcaagcgatccccttgccttggccacctgagtagctgggactataggcatgtaccaccttgcctggataatttttttttgtagagatggggtctcactatgttgcccaggctggtcttgaactcctggcctccagtgatcctcctgccttggcctcccagagcgttggcattacaggcatgagccactgtgccctcctgcatttcctactgataaatatttttgagacaggattttgctatgttgcccagaatggagtgcagtggtgtgatcaaagctcactgcagccttgacccacctcccctggactcaagcaattctcccacttcagcctcctatgtagcttggactacagatgcatgccactatgtctgataatttttgtatttttttgtagagacagagtctctctatgttgccaggctggtctagaactcacgggctcaagtgatcctcccacctcggcctcccaaagtgctgggattatagaggtgaaaccactgtgcccagcctctatctacctacctacctatcaacctgcctacctacctatcaatcataaatatatttcatatatacatgaaaataggctttaaaggcagaaatgtgactggttcaggcaaaatcctgtggcataaatgtggatttttatgtttgtactagtgttagaatggataactggaagaaccctaaactaaaaagggcccactcctggcacagagtgcctgttacaacagtccagggcctgcatgactcaggtctctatgccagggtcatgctggagaatgcagctttcagaagagtcacttcagagtgagtgaaatacctacacaaacatctggaccaagaggggcaattacctgtttggtatctttcctggtatgtcaatcagctctccctgcaccagcttcatgtagtgattcattgagaactggggccctaccaagaaggccccatagaagtaggagaaaccagcaacttccagcagggaaggaacaccacgtatggcatatttctgttgctcagaggacaaggaattctatgccaagaagagaatgcatggttcaggatagccttgaatctccccacaagagccactttgagtgttccccacctgtgtgccccactgactggggttcttcaaatagccttctctttgggggatgacaaatagttgcttcttgtggaaatgcgtatgtgtgtgcatagctggctgttgctgctttagcaaatgccttgctggcattgatctctggactttgtgcaagagctggatcctgggcaaattagatttgttgatccttgctcagtgctatctgaaagggagattgcacaggctggggaatgagggagagctccgctctggaatttgggttcagtcttttgttaacaacttttttcttccctttcattaagtcttgaacctctctgccgatgaatgggtacttacctgatctttccctccgtcaaagtagtcaacagccaaacctgagcagagagagaacggatgggtagggtggtgggagaggacactgaggatgtggcctgtagactgagtgcagccagaagtgtatggcggggggcggagggggggtgccgaggaagtttttagtgagatgggggagggacctacatgtaaggaaggcaggcagtgaccatcactcaccaatcagcttcaaagtcagaacacaatgtggcattgtccacttgatatcgtagttgccggtggcagtgtaatagtatccagccagaaggtaggcctaggagaggcagaagtatttattctagcatcactactatttcttctccttgctctgaaattcaatgttctctttcctttttcctttctcctcatcccatcattaaaagccttaataaattcctacaaatggaggtgctgaaaacctgtaatgggaagagcgttgctcaaggcttcttggcaaaatgagggctaaactgagatgagaatttagatgctgggaccacaggtgcatgccaccccacccggctaatttttaattttttttgtttcaccatgttgcccaggctggagggctaatttttgtattttttttgtagagatggggtttcaccatgttgcccgggttagtctcaaactcctgggctcaagcaatctgactgccttggcctcccaaggtgctgggattacaggtgtgagccactttgcctggcctaggcttaggttctttaactcattctaagttgcttttctgtcttgccttgaagtgactctgctcctggatagtgggttaaaccaaagagcctaatggcacagtatgcaaagggttagctggtggcccttccttgaggcaggcaaagagttaccattacaatctgtggatggaacacttgggcctgtgataagccacctacctgaagtcatactgctaagtgctgggagaggggttagaaattaggtctgctaatttctataccacagtcccctgcctacccctgtcccctgaaccgctgtcagctgtagcctgagctgctaagggaaagacgtttaccatctggaagcaaaaggtagtgaggacggcagtgatggtgcggcccattagtcgaaggatgaggaactgaagcacaatacacagcagggagtggtagagctggtttcctggatgcaagaagagagaatttagcctggtttttacactcccaccgtcctgagacttccaatcacaacgtaatatataaagaaaaaatgttggcatcaggatcttttttttcagaataacctcatgttttggaggagaggatggaaattatttattaaaataaaaaagattattagggtgttattttatttcttttctttttttgtttgtttttttagagatgcgacttgctctgttgtccagacttgagtgcagtagctcaatcatagctcactgcagccttgaattccgggctaccacacccagcttgttactgtatttttgaatgtctgaagtgaagaatgaatctaagtggggactgcttggctcggtcattcagttacatccacagcacagagaaactgaggattctttgttgatgaggtatggcaagggtaaccaccctcaaaatgtttttatctgacagaagaatgtacataaaagaaaaaaaggaaaagttaagctgtgttcctcttcatacaaccctctttgcaagtgggagcattataacttccctacctattagattctctcaaggaaattttgttcaagtctgttccttccaggttcccactaattgcggtgtcactgctaatttagtttactcaccaaagttaaaataagcaattgagaggcctgtaaaggtatggaagaggtggatgaggtaggtctccttgtagaaaaggtaatgccgataaaacaaagcaaaggggtaacctagatgggggaaaagataagaagagtgttatttgtgcctggtgccatcccagtttggtttggaagtttatctggcatgaaacgcagcccagagggagagagaaaaaaaaaacaacatacattatatggatggcaacagagaaggcaataacggtatccccaagaaccaaaagttttttgtaaatacaaattttgaactaaagatattaatatttgattgaggcaatataaagctgggtcctaagactaggtttcatttatagcttatgaactattgccagacattttctcttacttgaattttaaaaaatgatacaaggaagctaggcatggtggctcccatgtataatcccagcactctgggaggctgaggcaaggggattgcttgagccgaggagttcgacaccagcctgagcaacatagcgaaaccccgtctctattaaaaaacaagatacaaagatttgagcgtacccatctatgctccagaaacactcatttacactttgtgatctatcttgctagcactgtattatcagattatgaggaaaaatataaattaatatcaggctaaatactggaattgctgactgcatatatagcagttacaagttatgtggagatactcctcacagtctgtaatctgggcatcaaccaagttataaaatccatttaagtatactaaaaaaatgtcttctaaagccatgattcagagtatagtccaaaggccatgagtgaaccacagaggatcttctgatgggtcatgaactgattatacatggccaagggttgcttattgaattaaaaacggtcaataaaatttggtattcctaaactaaaattagcacattccatggctttactgcagactcaccttcagtgttctatctagaggtctggcggccatgcctggcaacatccccactgcactagtgcatatgtggaggatggggatctctcaactgctttttggaaagacattctgcctattctttcattgattattctcttgagttggtcatggtttatactttctgcaattcttgcttttatttttatttattttgagacagggtctcttgctctgtcacccaggctggagtgcagtggcacgatcatcgctcactgcagccttgacctcctgggctcaagtgatcctccaacttcagcctcttgagtagctgggaccacaggtgcttgccaccatgcctggctattttgtaatttttgtggacatgagttctcactatgttgcccaggctggccttgacctcctgggctcaaggaatcttcctgccttggcctcccaaagtgttgggattacaggcgtgagtcactgtgcctgatgaattgctgcgattcttgcttttaaattatgtaactgcagtttttatcatgggcaatacagtttactgtgagtttgcttaactctaaaacgcttagaatagtatcatacagaaataaattgctcaattatttgttaaataagtaaatgcacacaatcatgttatatgttggtttctgtccttctagtcatttttcccccatacattaaaaaaaaaaaaaaaaaaaaggctgggcgcggtggctcatgcctgtaatcccagcactatgggaggctgagacgggcggatcatgaggacaggagatcgagactatcctggctaacacggtgaaccccgtctctactaaaaatacaaaaaaaaaaattagccgggtgtggtggcgggcgcctatagtcccagctactagggaggctgaggcaggagaatggcatgaacacgggaggcggagcttgcagtgagctgagatggcaccactgcactccagcctgggcgacagagcgagattccgtctcaaaaaaccaaaataaaacaaaacaaaaaactgtactggctggtgcagtggctcacgcctgtaaaccaaggcactttgggaggctgaggtgggtggatcacttgagatccggagtttgagaccatactggccaacatggtgaaaccccatctctaccaaaaatataaaaaattagctgggtgtggtggcgggtgcctgtaatcccagctactcaggaggctgaggcaggagaatcacttgaacctgggaggcagaggttgcagtgagcagagattgcagtgagcagagagagccactgcactccagcctggtgacagagtgagactctgtctcaaaaaaaaaaaaaaaaaaaaaaaaagttacacctgtcggccgggtgcggcagctcacacctgtaatcccctactttgggaggcttaggcgggtgggtcgcctgagatcaggagtttgagacgagcctggccaacatggtgaaaccccatctctactaaaaatacaaaaattagttaggcgtggtgcaggcacctgtaatcccacctacttgggaagctgaggcaggagaattgcttgaacccaggaggcggaggtggcagtgagctgagatcacgccattgcactccagcttgggcaacgagcaagattctgtctcaaaaaaaaaagaaaaaaaagttttatgaggatttttgactgtacaaggggtgggatcccataggacctgcgctgttcaaggctcaactgtaattaattctacagatatcttatggattactggctcatgtattcattcaccaagtgtttagtaaatgcctgctatatgccaggtattctgtttatgaagcacgtaattgggtaggaggtggcatgtgatggttcgttttctagctggctgagatgatgggatataggatcactagctctagggaggtggagacatctatgaccctttcaggtagatcaatgagcaaggaaataggatcaagtctcatatatttcacatgggcagaaatttggcagagacagaacaccaggttagcagcaaatattgctaagaactagagccaggaactagaaagtatatagactaaatgtcaatgccttcaatcttttgctttatttttacttttgttttagtaacggggtataaataaaaaaatataaaacagtagataattatctagagcactcataaataagttctaggtagctaagtttctctctttaagcatgaaaacccttaaccatttggaatgctcgaaattaaaaaacaccacacatattactctgcctctttaagttgaatctaatttaacattttctaggtgtctggatcgtatctattccagagtaaagtcatgatggctttatga

SEQ ID NO: 198 - DNA, 12261 bp, Homo sapiens
gcttccaggaaagctgatggggtctacatgcacttttcctatatcccccactgacaagtacagtgaaggccgaatgctcagtgaacagtaactttctgccctaaatccaggtgggtgatggatcaacactgaacttttatttatttatttttttagaatatattactttggctgggcgcagtggctcacgcctgtaatcccagcacactgggaggccgaggagggagaatcacttgaggtcaggagttcaagaccagcctggccaacatggtgaaaccctgtctttactaaaaatacaaaaactagctgggcatggtcacgtgcacctgtaatcccagctactcagaaggctgaggcacgagaatctcttgaaccctggagacagagatttttgttgtggtaaaatatacataacataaaatccacaatttgagccatttttaagtgttgactatacaccatttaaagcaacaaaaatgtttgcaaattcgggttttatccaacaatgcatgcatttcctgtagattttattctcacctcacctctgtatgaactctctgcctctgcttctgtcaaatgtgtccgttccctaatattagacatactttgtgctttcctgcttaattaattgtttatacagcccttctctttccttttcacttctgctttcctggccaccacacctcttcctgttgggctccatggtagacatccatcagcatttactccttgcctcccagggaatctaggtcataaagggcaccctctttgtttatagcacttaatagtaattgtaacatctctatgttgtctatattgtcatttacctcttctattaactattcacatgctaccagataacttcttttattaatctgtatgtatatgtcaggttctatagtagatgccaggtctccaatagtaaatatgaatatgattattaatattaaatatgatttgtctccttttctcatggaagttttatactctggacaaagggcagacattgaacaatcactgtatcaatcagaataggctatgttgtggtaggctaacaaccttcagcaccttcgaacaacaaaggctgattaatttcttgcttactccatttgccctggtggctcagctgtgactttcatggtccttactcatggaccttccacactgagggagcatgctgcatctggggaattttggatatcaggagcactgagaaaaagagaacacagtaagtctcaaactagctcttaaaactccttcctcacttctcctcttgtttcattggcaaaaacaagtgacacggccagttctggcttcaatggttgatagatatgtaatcttcccctgaggagtttgggtatcgtttaactggatatacaggctatacatacaaatgcacaattgcacatttttatgagactcaaaacccttccaaagtaaatttgattacttctgtttgaatttggttttgaattttctagaattaaagggttcgaagaaatgtataaggataatcttgtccaatcccaaatggtttgacccatgactctcaatctctgggcctctgcataagagtagagactaaattattttataggacaagaagtagagtaaacatcctaagtgcttgccatagagtaagtaatatcacacacacacacacacacacacacacacacacacacacacaccacacacacacatactacacacacatacacacacaaaaagatagatatatagggctgggtgcagtggccagggaggccgaggccggcagattgcttgaggccaggagtttgataccaacctgggcaacatgtcaaaccccatctctccaaaaaaattacaaaaattagctacatggtggtgcatgcctgtagttgcagctactcagtaggctgagttgagaggataacttgaccccaggaggcggaggttgcagtgagctgagatcgcaccactgcactctagcctgggtgacagatcaagaccctgtctcaaaaaacacaagaaaagatagatagatagatagatagatagatagatagatagatagatagatagatagatagcaagtgcttataccatggaccattctaaatgtttttcatctattaactcaagagtcaacaaactttttctgtagagtaacagacactagatattttaggttttgtgggccatgagatctaggttattactacataactctgccactgcagtgcaaaagtggccacagacaatacataaacaaatgatcttggctgtgttccaatacggatttatttacaaaaacaaacagtgagctggtttgacctctgttttaacttagtttattctgatgacaaccctactgttatccccattttatagaagaagaggcctgtagaggtacagtaatttgtagaagtgcagttgaggcttgtagaggttcaatcatttgtcaaagttctctcatctggtaagtgggggagccaggctttcacaaaggcaagttggctccagggttcatgatcccaactgttaggattcatttcttctctaataatgctactctgctgaattcagttaagctatcgaagtatggatcagaaaagagggttgggcttccaatatatttgctcattttatggatgatcttttctgtctacaaagacaaaagacacaaattatttgtggtttcattgtgctggggttgtgtgatttactgagccacactaaatacacaacaaggtggtatacaaagtggtcaaatgtaccatctgaatcattcttgacatacacggacacacaactttgggggtcttcaagtttccttctacccttcccagcagggtagaagagaagacaaaaacacagcagaaaaactctgtccaagaatgggaaagagtagttatggcatgcttaggtggtgggaaacagctgatttaaagttagtaaatctgaatccaaataatggttcgatttctctgtgcaaccatgcttaaatccccgtgcttctccaaatcggagctttcacgtctgaatcatggagatagtatatctactaacagatgtgctgtgaatgataaaggagtttaagtaagtgcaagtgttggctaaattacagcatcttatagatatatgtaaagtcatcgctattactggattgtccttagaaataagggttttgcttttgttgtatttcaaggtgacttaagtatggttgactgcatatagaaaaggaagaatccaaacatgtactcgctgtaattgagtctttaaattgcatatttaaagaaaattactagcttttaaaatcccaagtgattttagagaagactcacagaattgttaaggctttccacaacatatttactcatatagtgggggtggaaggagttggatttgcccttgtggttttcatagagttgacagcttttcttgcctattccacaagttctaatgctacataatttttaagatttggtccactcagctatcactgtgatctcccaacttaaatctgttatcaatttttcagtcctctcctagttctttgcattcacttctatttgccacaggttattagagttatttgtccattcattcaactaacgtgtggctgtctattatggagaggcagtgtactagatgttagggacacaaagctcatgaagtagatatggcttctgtcctcagtcggtgtatctctcagtcagaatctgttacttgagggggcagctggagctctttctcccttcctagtaggctgagcatatggaaaccagattcccagttaattttagttgttgttttcttgatacgtaaagaaaagatccataaactcaagatgctttcttatgaatcaagttttcaagttttatagcattcgctttgtactacttgttttgaccccattgagaagttttatttcttctgttctcctgattcttcgccattttagcagcaaatatgtacttaccatccactatgtgattgatgctttggaaatacaatggaaaacttggtagcaatgaaccctctgcctttaagaagcttatattctattttagattagggaagcaggaaggtctctctatgtacaatagaatgggaaagaacgagccacataagtggtgtcaaagaggaatgcaaaaagacagcatggctggagccaagtgaaactaaaaagaagatgaggttgactagagacatgattcagatcaccagaggctgggaggcaatggagagcattttgatttgattctaagttcaatggaaagtcaccaaagagttctaagaaggagtataacatagggtttgacacagtgggtgggtgaagaagatcacacttgctactagagatggggagtacgttgtagaggggaaagtatgggtgcagagagatcagatgggggttatttcaggtgtctacataagggatgatggtgacctcaaatggaagtagaggtaagtggagagatgtgagatacattttcagatagcaggagtaggacctgctgatgggtgtgttgacatgggctgagggcagggatgaggcaggaagatggtaaaatcaagaatattcctgggttgcgcaacactcctctgtccactccctgtgatgcgatttggcatttcccaactctgccttccctcctaaaaatcaggaatcggtcttatattaattttattttgggttctgtatctgttgaattccataaacatctctcatttttttctggttactcattcatctatcagaaattgtgtaaagtccatattttttcaaatttagacacctaaataataaagatttaaactattaataaacatgtacttaatttcaaaaagagcctgctagacataggtgaatagggtttcccatttcccgagaggaggaagaggtgaggaagattgtgtggggaaaattgagaggaaaatggagcagtagtaaaggagaatgccagctaaagggaattttgttttgttgttgttatttgtttatgtgttttttgtaaagatgagatacagtagagcatgtttgcccagtgagtacagtgatccaatagagaataagctgtcgtggtgcagatacaagaaagataaaagaacagacgtaatgacatccttgagaaggccacagggtgggggctttccagctcctgcagcaggatccgccttgagtgggtgattggggtgggtgcagggtagagagagattctaactgagcaagtttaggatgagggcttgcactccagaaaaggctggagaaggcactgagagagctgttaggagggaagccagagatgagaaacatagaatctcatctcagggagtgaaaaaggagactcctagacacaggatggtgggcctttgttgagcgactcttccatagaggaaagtgccggatagctggtttctggagaatttaagtattactgtattatacattataatgcatctttgtataatgtttttctcttattccccaagatctttcattttcttttggaaaatgtggacagttagtctccatgtatatctctgtggtttcttactcttatattaattttgttttgagttgaatatcaattgaacttcatcaacatctctcattttttcaggttactcattcctgtttcagaaattgttcataaatgttcattattttcacatttggacacctaaataataatgatttaaactaaacatttatttaacttcaaaatgtatatactatttgccttttttatggtgagaatatatttgtataatacctatttatgtcaacacagcaactaacataataaatatactcttagattataaaagctcactttatataatcaaagaattttctttatgttataaaataactggtatgaatatgctatttagattatcattcaattacttacacctcatttctttcaaaatgtattggagatatttcccaatttgcaggtgcttggaaggttggagtgatgagtgtgtgtttgtgtggatgtgcttttggatgtgtatgcacacaaaggtttcttctttcctaatctaatatttcttttttcttttttggcctgacttctatacacaattttcttagcccttctggtaggttatttaggaactcaaaagtgctgggtattggctttcatgtcctgccagccttccttcttttctttgggagaatgttctgcattccaggagaccctgctcccaagcatcattcacatggtcaggctgtccaggtgcctctcaccccacttggagatgaggctgctctgttttcctactttggtaatccctgcctctgttctaagggcctggccaaaacatggaaagtcttactcttttttcaatccgatcttacagcagtgctggtgacattttattctaggtagatgtttgcatgaggcagttcttaaaaaaaagtttaaaaaaagatctttctgtctctgagcttttttcatctatttcctccttctgtcatatttccagaaggtaattgagagtcagttatgttttattttattttaacccagtgatacaggcaatgatgagtttgcatgttagtaaaatgggaaaatgagatgtgtagaggctgaggggcaaaatgagaatcggcacaaaaatctgattgatacaacattctgtgagaggcaagaatgtccctgttaggcaggaagccctgggtaagataacctggaatgggtgtatatgatcagaacacagggcaaaaaaaaccatcctcaagacttatcgccatatgaagactgaaagacaaaccaaccttctgagtgaactcactgaaaaaaatcttgtgtgcctggaaacattctgaaaggggcccctcccttgggctataaaatcaatggtgaatatcattatcaaatcagatatgggtaagcttttacagcatccagttcccagtgactatcccttaaagaacaaaacaaaacaaaaacaccactatccgtaggcaagtgttttctcttgaccacatatttacatatgaaagtctattctggggaaggacagtgaggaagatggaaaaatcaatgaaaagctccctctttgaatttgtagaggcctttctttcaaaggtgagcccttctgcacagatttgtttgcagagacccacacaggccccatatttatttagttcctatttgaaaagaagctttcctcctgccttagaagaagctcattacagatagacttcacctttctgttgcaaaagatgtttccttgaaatgaaaatgtaatgagtgttagatcagtagcatgtagctgccaggctatctctttgatccagtttggaatgcatttgttaaaaagctgctttattgatttttttagctgctttttgctgtgtttggatcatttgtacatatacacatcacaatttttgctacatcaaagtgcttaataagttcactgcactcaggaaatagcatacaaaacaaaggaactttgctctataaagatttctgcctcttaacctccagtatgaaagttgtttttaatgtgtttttttttttctgaatagcttcaaaatattttatgcagtcttcaatgagtcagccagggccccgcttcagatctccttctttgaaaatgatgcattctggaaaaggaaggatttgattgaacgagtaaacacatctcacatccattctgctggacaggagtcattttacttcaattaattatttaattggctcaatttgtgggtagcggcagcttccaggaaagtgttgacaatatttgatgtatgtgaggatagctactaatttagtaataagttgaaatttactaggtaactaatgtgatgtttgtttattaggtccaattatatgacaaagaatgagcacattataacctttaatgctgattttttttttttttgtatcatgtacatacaaatcagtgttaagtgcttttaactctaaacaggtatttcctgggggcagactcggagccagctcagtggaaagcacgactgggaagacagagctgagtttgctccacttttggtctcaggccaaaagtgctgactgtggtcaagtgtgggctgcacagaggagctgtccaatccagctttccaactagacccctcgtgctggtattcgggcaggctatacctcctgcagatgtacaaatgaacatgcattaaagattttatttacctcattcagtgagggagctaggaaaacattataaacagttgaaatggggatcaaaaccaacatttatttgtcagtaatagtgaaatgaatatgcaaatggagtcaaaactggtttttccatgggaatggtgtcggtggggagggaaaccaattaaacccctatgacaggtggaatttatggtgttcattagttacctacagactataggtttgtaaaatagctcaaagacaatgaaaacttagaatgtgataacctctagagtctagaaattgtggcgcttcccattgaagcacacctttttttgtacacctccaacagtggggcggacactcaaatccttttctttttgtctttaaagtcaggaaagtacgttgacttcaggggtcaggtgaaggtcaaggggtaagaaaataggaggcaggtgataattgtgggcttccagtaatattctggtaagtgaaaaggaaacatgacctaaaatagcaatgcatcaactgagtatttaaaagtcttttgtcttttctagaaattttgtcatcgtggtggtagttgatgtaaaaagtggttttcctactttgaattttatcttttattctctctctctcttttttcccctccctcctttctttccttccttcctttcttttttcttccttcctttccttcccctcccccctccctccctcccttctctctctctctttctttctttcttttccatgacctcattcagtgccagttcacattttcatcttgatccatccctttgtacattggactctcaaaaacagcaattcttaacagctcaattggatttgccatttggggccatctctgtacatggcctctaaataaatttacgaactccccttggtgcaaaattgagatatagatgaatgggtggctccctaagagaggaacggggacacctgggtctggtggaaccatgtcctgaaagcactatatgactttggcaaacagcactcttctctgggtgccatcccatctggtccccaagcagaagtcagagggtgcttagcagccatggcctggcctggctgcaaagggcatccagtcagcattgctttgtacactggagctttgaaccagtgatcctcaagcctctccagtcaggtcactgggaatttatactttcctaaaatgtccgttttcttgctgtttgcctcagaatgaaatctcacctcatgtgatagtagtcatgaaacccaaagacacaatgtggagaggagttcacgagaatgcctggtatgaggagagcaccccaaatcactctttatgagctcatctcaaatctcgggctccacttatcccacggtagtttttttgtttgtttttttgtagttataaagatataatttacatgtaataaaatttatttttaatgtgtatttcttcttttgaacatatgcttagagtcacactacaatcagataatgtttctgtgggacacccaaactttcctggtgccccttttttgtcatttttatccctggtctcccaactttagtaaccactgttgtgatttctgtctctatattttgctttttctagaatgtcatatcaatggaatcctagaaatgcaaacttttgagtctggcttctttcacttataatgcatctgagatccatcaatgtcgtcacacgcatcagtgcacgctgagtcgtattcccttgtataaatggaacccggtttattgtctcacctactgaaagggaggttgttgggttgtttttagtgatgggacatcatgaatacaaccagtagaaacgttcatttacagattttttatatgaacacagtgtagtgtttctgaattggatgataaatacgtgtttaattctataaaaagctgtcaaactgttttccaaaatagctaatctatttggaattctcactagcagtatatgagagttccagttgttccatcatattctcaccatcatttggtattgcctgcctccctcccttactcaatcttcttttttcttttctttttttccattatattctcaccattatttggtattgcctgcctgcctgcctgcctgcttgccttcctcccctccctccctctctctcccttcccttccctttttccttccttcctttcttttcctttcctttccctcccttccccctccctcttctctccctccctccctcctttctttctttctttctctttctttctttctttctttttcttttttctctctctttctctttctttctttttcttttttctctctctttctctctctctttctttttcttttttctctctctttctctctttctttctttttcttttttctctctctttctctctctttctttctttttcttttttctctctctttctctctttctttctttttcttttttctctctctttctctctctctttctttctttttcttttttctctctctttctctctctctttctttctttttcttttttctctctctttctctctctttcttttttctctttctctctttctttctttttcttttttctctctctttctctctctctttctttctttttcttttttctctctctttctctctctctttctttttcttttccttctttttctctttttccttttttcttcctttcctcctttcttgccattctactagatttcatagtgttatctcatacggtttaaatgatattaccttaattactaatatgttgagcttttttttttttctttacatgcttaaaatcttctctgttcaagtgtctgttcaaatcttttgactgggctctctttcaaaagctttccaattcaaattctatctttccaaaaatatgaattcattaagtctagaaagtatcgatcggcgtatttacaatgcctgtggatgcaatggcgaaacaaactcctagaacagattattttgtagtaccttaatacatagatattaaagcagtaatcaactcaagccagagtggattcactaagaatgaataatgtaaagggacccatttcctttctttttcatgaattaacttaattttatattagaatagttgaatagatatattttatttcatgcttgtgaacaaaatggagaaatatgaactgcgtaacaataggtaaattatattttgttgaaaaactattaccccaacatattaatctttttgaatctgtctagctggaggaatgttccttagtaattaaattcaaaataatgtaatcatcaaaaatattccaattaagtcaacaataattgttttataaatattattaaatgtgtatattttattcttattttagaaatatcacatattataataaatctggtatagtttcatgggagaaggatcctctgacattcatctcagaatgctatacttcacttaaagtttacttccttttgttatattaaccccacttcatgagatgctatttactctactttttttaaatgtgtatgcctcactttaatggtgttgcttttgttttttttaaaattgcttatctttatatttgagctttccttttacccggtgggtttaagtggcatactgcttgcttcagcctatttcgagtaattctgaggtagaggcaggacagattgcgaggcctgtcatgccaggagctgcaaagtctctccccttcttcctgggtcttggtagacacttgagtttctgccatgttgtcccttccacctccaggcgctgctcctgcctgagttctgcagccaagtgccctgtgattgctataagaaggaggaatgaggactggggggcggcgatgcagcaaactgaccagctgccacctctccattctcccagtcaatctctctgatcattgtctctgcgctagctcacagtctggaagcttggagagcctcttttgtttctccacttttttttttttctcagagttctctgtaaaagcatgttttgggttgtgctctcctgtttcaattaatttatatctaccctctgacttttaggaacttattatattatttgacaaagcacaaatgtgcagaaaaatcctaggcctaataaacccagatgttctggatgca

SEQ ID NO: 199 - DNA, 1039 bp, Homo sapiens
tatctttgaagaccaaatacccaaaagatctgcttcaaccttccccagttaatcttttgccagaagattcacaatctgaatgtggctgtgagtatttgattagagtattagtaggtgaaggaaggtggtatgcaagaatcagctttaatattatccccgtagaagggaataattggtgattagttttcaggctatataggactattcctcctaaatgaatggataagctgagagatttacttctaaagaggtatggtcttttcattttaactcgagattttaggaaagaccaacttaaaaagaaagcaaaggaagtttcaggagatttcagaatttagaaggaattctgaaattctcttctggggaaatgaaatcctaagacttgcatggatatttctgaaaatcaaaatgaaatattttggttgcataaatcgtcaactgtagtttttaactaaggaaatgtaatttaaaaaatccaagtgttcgatttacataagaaatagagttatttaaatagaagatttccaaaacgctgttagtggtctttgacgtctttaaaaaggcatttatatttgtgaaaagatgatctattttaaggtgtaattatttctaatgtgcctcattttggggtctcttgagagattagaaattgctaataagcaattttaaatattttcgaggtaagttaataaaacacttcatcggtaattcatgacttgttatcattctcacattatccttgtgtgggtaaaggcctgtccatcattggaagtaattggaaagaaaactttgcctgaagctacatgagaactggaacccttaaatcatgaatggtggcaagattccaaaattaattatgaagactattggaatgatgtagcatcctttaactcttattgtgatcgacagaaagtatcatagatggacaactcactttccctttgctctgtgcttcctggtgattttaggtcacgtccactctgaaatctgagctgtcattaaagccatgtcttcgtgtctgtctgtctgaagcagcaaa

SEQ ID NO: 200 - DNA, 176818 bp, Homo sapiens
atggggatggggaggagaagtgggaatgggaaattgggagtcagaggggcaagtgggagagaagggcgcacctgccgggataacaggccagatgaagtaaatagaaaatcctctgagctcccctactggctccagctgtggagaagggggaggagaaaaccctgtgggacaggggaggagggtgagggctcctcttaggaagttatttaagagccaactgtcttgtctttcccgagtccgtttgaggaagtccccgaggcgcacagagcaagcccacgcgagggcacctctggaggggagcgcctgcaggtaagccaccgaccctgcaccctatgagccagggcccgctgcgtccaccttctgcacctcggtttcctggttgaaccagcaagcggcttgctctgggccctgtggcgccggtcacaggcagctccacttgcccaatcctggcttcccgcccccaactccgcacctgcccagcccagcttctaagcgggacttctctcaggctctcgaggcagctctcccgaagccgttgcttgcttagaatgccaccaaatggggatgggggagttggaggtgcttccccaagggacgagccccctttcctcagggagcagattatggagctggaacacaaaaggtggagggagtggggccaagtgagaacagcctgctagactggaaccccgccggcttggctccccactcctgcgcgcctccccactcctgcgcatcgcctgcctccgtcccaatttggagctgaactcgagccacttctcctccttagacccgcccagaagcgagggctcctgcccgccgcactcacccagccaggcgtgcacctggggctccccccttctcccccttagcactgtgtctcccgacagcgcgccacactgttctgcacccctggcaatgccgcagcctaccttcggtatttctcactagaggatggctctcgcagccttctccctatcattaaccctttttcgctcttctccctcccttcccccgtcagctcaccaatgactgtaaatatatttatctatacttatggatacccattcacaccttatgcatccaaacactcctgtctccttctcagaccagacaccttaggcgtggttgtcttttctccagcatgttgttagtgctccacatgtctctggaaccatctctctactctggtggcctctataatggggactcttcacctcttgggggtgtgcctggtttttgaaaatagccaagtctccaggagtcatgactgggtaatccaggggatcaagggggaaccttcactgggcccagaaacaaagtcccccttcatttggtcatttggtcaacaagtacttactgggcactgaccgtcaggtgtgtgttgtttaaactggctcagtgcctgcacaagctccaagggaaggggaagcaggcttggggaatgggaaatgttggcaaccctgacttcttaagcctattgatagccctattgaaaattgcatgcccaacctctccacctccttatcctcctccatgtggctcaatttccaaagcagttcctacctcctcacccctaagtggatttacttatggctcttcttgggctccaccctaaccctatcagactataatctatcagagcaaacattctgttttgttctctgatgtatcccatgtacctagatcacagcctggcatgtcataggccctcaataaatattggttgaattaaattgcaaatgtaaacgctttagaagacaacatttgtctggacatggttgtgtgcgtttattcttaaaagtgacttataatctcataaatctgtatgaaatgaacatagatacagcacatgcatataacaggaaacatttcttgcgaagatgctgctgtaggattatggagggtgggggaatctgggtctccaaaaatcttttaatttttaaatttctttgaataagccccttttcttctgctttccatatgttttgacacatacaaaaatctccccaagatccttggggaactgtattccatcattagactaatccttgctgccacttctcagtttttatttatgcaaacggcaaaatgtgttgctcaagtgctatcacacacagatatatctgtttctctattttggaatccttgtctcaaatgttactcactttacatgccttttctgttgtcttcttttttttttttttctgaaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaaggtatgagcataccccccttccccaccactctgggtccaggcacagccgggccctggcccctcttccctgcaggtaaacatcctctgtctccactggggttcccacaaaaggaagccccctgccaatctctggttttataaaggaagaaagcaaaagctttcttttaagtggtgaaagcaccgaagacccagagccttgtcccagttctgccccttactgaccttgtaacctcagagaagttgctttgtctttctgcctctcaactatttcctctacaaaaccagagtgctggattagctagggcctcttccagccctactgctcaatgctttagagaattttctctagctggaatattccacttccaaaatattgtggctgttttgattgtctggcttgcacctccttccttctccctcctccctcctccatccattgctgtgaatttcagagccggggagaagtgccagactctgacagtaatagagatagaagccctctatttctctccagagcagcctggtgagctggcaaggcaagctgcttccccagcctcttgcctctgcctgatccctagaaacctgttccgggtacagcagccggcagctgacctcctctcagccctgtcagtggtgacaaggtccaggtgccagcactggtttggtgatacagacatcattcccctgggccatggcagggacattcagactcatgtccccgagtggcattgagcagggagtcttttttgtcaataacattcatgcaccaaaatctaattttactcctaagggtgttctgtgctgggtttcactggggataaacacctatttgctgggataggtgagcatggtcatgctggagctgtgtggtcgattcccctcattagaaggagaccaatgcctgaaagcccagattgatgcagctctccatatagcaaagggaaaggggaagtgcagtttatccagcaagccagacacttgcccaggtgttgtggactggtgtcattgtgttactgtcacactagatgatttgatatcaaatagtgaaatcagggaggtatccagtaccatccaagtttgggaaaagaagttcacagaacagaagggcatcttcagtcaggtggtagagtttgaggggctaagacgaacttgtagttctgaaatctgtctcccagctggatgccactctctaaaaccccaccttgacagccacagaactgagtttaagaggacttgctaatcaatgaatcctcatccccatgttatatgttaggaaatagaggctgaaggtaagcagttgatattcactgcttacccagtctacgagtctttttctttaagaatgcaaataaaatgcaaaagcctacagatatcaaattattaagcaggttgcctttgtgtattccatcttctagcaaaattcccctgtggcccaaaagactctgggcccccggaaagggggtgtaggcactggaagaagtgggcagtaagaacaggaggagtaatgacacaaccgtccttgccacgaggagtcaggacacagccacccttgccaggattgggaaaaacgggaacctctacaaaggcagtgcagggaagcagggaagcagagagcagaggcagaagacctggcttcctgttccacatctgccacttcttgctcactctgggaaagtcatattggtgcccaagcctcagtttctccatcagcaaaatggaagcaatgcctacttcacagattgtcgtgagcatctagtgagcagtgtctgtgatcaagtctgacccacagcacgtgaccaataagtgttcattgactgggaatgtgcaacttatcatatcccagcaaggtcaggaaagcactccagggaatacttgttcctatgaggaatatgtacgacctgtagcccccataaatctgacatctgaacaaaatgctgctagtaagacattaaaactgtcagagaacatgtgcaggtaggccaattaagaaaaataaaatctgggattactgcttttgttgatttctggaggcacaggtggggagcagcataactgaattactctgaaaaaatcagtcattatttacttggcagacatatgtgtccacaacccaagtgacattctgggatatccattagaggcactggcataggaatatgaatgtccagtgactgtagaatgaatgaacgaacagtcaatcacttgtgaattgaatgactcatagctctagtggcattataatttattattaataacaagctacagatttcatacatatgcattcatttaatatttttcacagacaagataagtgttacatgctctggggatacggtttctgaagcccagaatcatgacagcaagtcccagatgagaaggacaggaaaaaaactatatatatatatatatatatatatatatatatatatatatatatatatatatatatatatatatgcacacacacatagcagcacacaaaccatctgaacaaggaggtctatctcctggttaccttttgcatttcagatttatatttaattgttctaaaagcaggttttctggcactatatatcaagttttctccaagtcactaagggacgaaatttgctaagcgactaaaccttggaaagaacactcatttttaaaatgccatcttcatgcagttcacccagtggccactagtggcctctaagaggccttgtatccgcggttaccaatctgcggatgatgactttggctccaggaacaccagccccaagttaaactcttgtctccatttttttcagtggccactcttccagttagcaagctgctcttgtaatactgactgagaaatgcagagaggcaagaagaggaaaaggggggaaatggcggctttttcatttctaatagttctgtagcagtgagtcctgcccatcactgtgtgtgatatatacagtgttctaaggtatactgagtgtatataacgcccttaagtcatggctttggtaacatttggttaagaattattttggtaaaatctgtattttaaaatgtataaactcatgtaagtttcctctcatacacaccatgatattcaagaaaaaaaaaatgaaatatttgaggtaggcacggaaatcccagaggtgggaccagccattcagtggtagcgtttgacatctttgcatgattttaggcatctttaatgtcaccctttgaattcagttgtagccaggaaaggtactgagacgatctcctcagatttggatttgtatcaatttctaatagactgttctgcaggcttagttggtgtttctgaaaaatctctccactgccttcctggtctgaaaggttatgtgtagctggaaatgtaatattccagaagaaaccttatgttgttggtctgctttggctctatattgttaacaataggcgaccatttgtagcagtaattggaatcatttaacagttctattgtattgaattaaaactggaaagcaagcctggccctatttaaaaactgggttctagtagtttttcaggctaatggggtcttatacctttctaagaatctcctccatcccaccactccttgtcagaattaaatcaaccaattaatgataaacctcctctttgtgcagagtaaacctctctggattgaaggttactgagagactaagaggcattcagtgtatgactgagaaatgctattgtccagcagcagttcctcctttcattcagttcctggaaaaatatacactggttttcacatatgtgtcaggagctgctccaggctgtcccttgggacatgaagttgagtaagttagtccctggcctcaagaaactctcagtgtagaagacaaaataaataaaagatcattgcaattcagtgtaataaagactgtgactgtgatttatgcaaattgcagtgaaataacagaaatcaatgtctagcggtgtggtggagtggggaagaggatgaggagggcttcctgatgcaaggatattggagccgagacttagaggatgagtatgagtgttcctgacaggcaagcgcatggaaaagtgtttgcagtagagggaacagtatattgcaagtgaggagggactaaaagatgaaagagaagatataagcctgggaaaagatggcaggcatcacaccataccaggccttggggatcttgctttcctcctgcagataatgcgggacttgagaaggattctaattagcagaaatacataatcagaattatgctttacaaagtggtagggagggctgggcacggtggctcatgcttgtaaccccagcactttgggaggccgaggtgggcagatcaccagatcaggagttcgagaccagcctggccaacatggtgaaaccctgtctctactaaaaatacaaaaattagcctggggtggtggttggcgcctgtaatcccagctactcgggaggctgaggcaggagaatcgcttgaacctgggaggtggaggttgcagtgagccgagattgtgccattgcactccagcctgggcgataagaccaagactccgtttcaaaaaaaaaaaagagtaaggagaaaatggagaacaggagatatgtttggaagctgtagagatactccaggctagaagaggaatagaccagaggggttttagcccctggaggtatggggctcatttctcttgttccagcttcctctgagcacctgagcaatccttcaacattataggttccaggatgtattaataacaacactttataaattaagccacttaagaaaatgcttttaatcattctaattaaggacatgttaaaattctgggtacccaaaagaaatgtgagaaagagttatttttcctgtttttttttaaataaatcagtttctcatggatagcatttatgcttatagttcaataacaatattaccaaaaattgcatggagaattcagttcactagggaattcctagtatataaacctaaacatttaacttatttcaagatcccatctgtgacaggtataatcattctctgaagaatattttacaacctagggagacaataatttacattttgttcatattagacaaaaagtaggaggacagggaggcagttgctcctccggagatttttttcttttctttaacagtccattttccgatatgtttggaattaggctaaattgtgttaggtagacagtttgaaagctgtcactttgaaagagcgagctgccaagtttctagctaccgtatttaaaaaaaaaaaaaaaaaaaaggcggcttagcaatgagctgttccattttgccaggaactaggcttggacaggggaagcaaattcatttcctgtttgtggcaaacggagtctggatgatgataagactttttccatctaaactgccttgttaacccagtaaacaaagcaaaaatcaatatgctagattcatcaatgcttgctggaacacactccatggcaagggacatttcctaggcaaaatggacaatggaatgaacaatgatatttttatgtctatgttcatattttatacagtcatcttcagagtctttgatactatcagctgttataagaaccaaatacttggttgacctgtgtgtggctgactcatgggcaatgaaataaattttgttgaatcagtggtattggggacctcacctctatccccaatactttggacaacccattaagcttgctcatgtcttttccatttgactacagtctggaacattatttctttaaactctcaacctctctgtgtagcttttaatcttccccttcttagccaagttttattttattttttatgaaatgtctttctttgtttaaatcattttaagacagactttttttgtttttgttttgagacggagtcttgctctgtcacccaggctggagtgcagtggcgcgatctcggctcactgcaagctccacctcccgggttcaagcggttctcctgcctcagcctcccgagtagctgggactacaggcacgtgccaccacgaccagctaacttttctttttttttttttttagtagagactgggtttcaccatattggccaagatggtctccatctcttgacctcgtgatccgcccccctcagccttccaaagtactggaattacaggcatgagccaccgcgcccggcccccaagacgcacttttaagagattatacaggaaagttttacttatcactgccttagtttttccccacttatagtaccactgtgattttatgtttttcctgaggcattggcttgttgaagtgatattgcaacagagaatcaaaagatcacttagaaaaagtaacatgttagaaaacatcatgcttagaattaaatgtctaaagtataccagtatagatgatataatttaaaacaattgatactatcagctgtcataagaaccaaatacttggttgacctgtgggtggctgactcatgggcaatgaaataaattttgttttatacgtataactttatatatatgtaactttatatatatataaaaagtttgcttatatataatatatatacacatatcatatataaatatattgtttataatatgtaaacaatatatacataaataatatataaaaactatatattatatatgtaaacaatatatttttaaaaaccaaactcatgggtttatagttttttcatagtgaaaacaaacaaatatataaacaaatatatagtttgcttatatctattatatataaacaatatataatatataaagatataaataatatataatatataaatatatatttgtaatatataatatataaataatatatatttgtaatatattatttgtttatatccattatataatataaacatatgtaatatatataatttatatgaacaatatataatatataaacaatatatgtttttatatattatatataaacatatatattcatgatatatatgtatgtttgtttacactatggaaaaactataaacccatgagctggggttttgtctttttttttttgacttaggttttctattctcaaaggcattaatcagcaccctttttctcaccctttgttatcaacatataagcaggctagaaagacagtattttattccaatgtgaaacaaaactgctgatctggaggtcttatgttataaattcccacatcataccttcaactatatatatgtcctgaaactagcatattttgagaataaaatggtaaatgacatttaaaggacacctatggttaatcctacagtaaatgagataatttattttgaaatgaatgatcaactctacgctccaaattttcacgtaaaaggtgttcaggtgaaaggaggcatatttgctgtggcatttctgcacactgccccaggcactatagcaagataattaagacatggtccagtcttcaaggggattacaatcccatggctaaaaaatcacctatataaagataatacaaagagacaatgatacttttttttaaaaaaaaaaagacagatgtttcctgcgaatcaagaggagaaatgctttctatttacctgtggaaattcaaagcaagcctgtctgctcagaagataaggagtataaaatggcatgcttccctgggaaggctggaaggccactgctaaaaagcttcccagggaccttctttaccttgtgacttccattgctcagattccagcctcacaccatgccttctcagatacctgactacttaatgattggtcctaagggccaatccaaatgctcagtgctattatgattattattgccatcaatttctgagcatttaccatgtaccaggccctaggatagagcactcggtgcattttctcatttaatcctcacaccaacttcattttgcagatgagaaaactgaggcacaggacatttatgtaacttgccaaggtcacaaagacagtacgtgagagttgggatttgggttcaggcagcctagctccacagtctatgctcttactatgctcttctacttctcttaataataataacaacaacaataataataaacatttattaagaatgtacttggtgtcagccactctataagataggtacttcattcccatattaaagataagaaaactgaggctcagatagattaaataacttttctgaggctgcacaataagtaagtagtgaagcatttccaaaaacatattctgaaaaatgcagatctccaaagaaaaaagtttccatagtcatttacatttggaaaccattgcccctctgagatatctgtggtatacatcagcatattaaagtctcacatgaatgcttcagtaaagaatcctgatcagctttggttaggccagcattttccacactggtttaaacatggagctctaattcttccaatacctgtcaatatcccataaaactagcactatgccatgatggactgactctaaccagtctcactagacattaaccaggtacactaggctaggaggtaaagctggaaagccaggttttcatttgcaatgagaactaggatggatgagacataccaatgataccaaagaaatactcgaatatttctccgtctccagccttactttgccttgtaggtagagctgcttgggaagccaaggcaggactcatttcagggacacattatcatgcagggagggagggtaggaatagagaaggcaaatccaggagtaccagaggagcagtgccttgaacccctacatgcaggctaaactcacgtggcccctcacccagaacactgcaacagcttcttaactgggttcagcttccagctttgccccttccaatcccttttccactctgccaccagaagcagtttcaatatatatataaatctaatcatgtcagtttgctgtttcagattcttcactggatccaccatgcaattaaaacccaaactccttcgcatggtctccaaggctcgtgtgatgagcaggctcctccttactcttccaccgtggctcccactagtacatttcagccaaccatcatctttcaatttcttaagcaactatgcactctcttgcctcagtcttcacctatccttctttctccgcctgaagcattcctctccacccccctttccacatggacaactgactcctcttttgctcactgcttatgtctcacttccttcagagaaattccttattttctaccccctaaatgtgggttaggggctcctccctgatactcccctcagttctctttacttcctttgtcagagatgtctgacactgtgtcataattatctgtccacattttagcatctactgctgtgcgtttacttagttagtagttattagacagttgcctaatcaacatttatacccatgtcttgagtggcaacataaaatagcacacttataacattcccagaggacaagaagctagggagaatattaaatatattaaatgcatacttaggggttaaaatgatcttaagagcatgggacagtgagccaaattcaataagaagaaatttaacccatgcaaagtcttaatatcgaactaaacagaagaaaacaattgcacaaataaatatagccaaatagcaacatgagtgggtgacttgtaggggcctcaactgaattttgatccattgttgctagaaataacattagaatgtgttttaagggaggctgaggcagggggattacctgaggtcaggagttcaagaccagcctgaccaatatagtgaaaccccatctctactaaaacaaaaacaaaaacaaacaaattagccaggcatggtggtgtgagcctgtagtcttagcaacttgagaggctgagacatgagaattgcttgaacccgggaggcagaagttgcagtgagctgaaattgcaccactgaactccagcctgagcaacagagcaggactctgcctcaaaaaaaaaaaaaaaaaaaaaaaagaatgtgttttaagggttttgctttatcagatgcataatataaatcaacagtgagttaagagtatccaagacactgacaatatcttgatttgaaataatagactgtttattttaaaagatgtaatggtctcttttttttttttttacagaaaaaccacaactagagtaatgtacttaattccagaaaataacacttcaaaagagaaattgacaaagtggaaaatattccaaaacagagcgttggataaaagttctagaaataacttcttaaaaacagttaaataggctggatgtgatggctcacgcctataatcttagcactttggaaagccaagccggcggatcacctgaggtcaggagttcaagaccagcctggccaacatggtgaaaccccgtctctattaaattttttaaaaatacaaaaattagcggggcatggtggtgagtgcctgcaatcccagctactcaggaggatgaggtggggaggattgcttgaacccaggaggcagaggttgcagtgagccgagatcgcgccactgcactccagtctgggtaacagagcaagactctgtttcaaacaagcaaacagttaaataaatgaagaatgttttactcagaaaaaaaaaaaatcctatgagcagtctttaaatacctagagagtgccagctaaaatgaataagaggacttattctatatttatctagaagtcagaacgaggacccatggttagaaaaattacaaggaagcagatgtcagtttatcttaagagaagttttcaaataattagagttgtttaaaaatggactgtttgccctatgaaaaaatgagttccctgttcaaatggaagctagaagcccaagtagtagggctctcatgaaaatgtttcatgcagggtatagtagttctaccagatggctgagaaaatgctattgctgttctgtgagattctgtaaggatgtaatatcagtatattccttccattggtgctggtaaacggagaactgatgaaacccatttctaaggactttggtgtttagctatttttaaaaaaaaaactttaaagcccctgtgctaagaaagaggaccagaggagttgattgctaagctccttttcaacaggaacatttgtgctcctccagctcattcttgggctggtttatcacggggattgtggtcttaataagaccagaggacttaggagaaaggcagcttggaatagagaggtctagagaattaaacatctttagctcacagcataatggaaagaaagtgcccttcaggggaacatgtatacaacagggttctgagaagaggtaaaaataaaactgcatcctgcactttctgcttgccgtaatgctgcagtcagggtaacccggggagcaccacgccctgtgaaatggctgtcacagtttaggggcagtgagccacagtaagcctaggacccactatgtgccaggcatagtgccagacccactgcaccgttatctcattgagccttcatagaccttctcagggtattagtatcctcattttaaaataagaaaattcagattctgaaaggtaaagtaccttaacgcagtaattttgacacctgagattcaaactcaggattgcctgaactttgaattgctcagcagtgtttcaggaactcctggactttaggaccgaagaggatcttaaagagcccaacttcttggttttgactatggaacacaatggggtccaaagggaccaggcatcctgcacaggatttatgtgtggaggtaaaggaagccattcgactatggcaggagatgccccggcatgggtacaagctcagcaactgtgctttctgcgcacatggtgcttatagccatgaaggcaaatcatgcatcaggcaggggcagggagggggagggcaagaggccagggcacccctgccgacccttctaccctcccaccccaccttctccccaataactctttacaatgccaaatgcacatgcagaaaccagtctctagactagatcttctaaagtacagtgaggacagggagttaggatgacccccactttcagtcatcattcatagaggggaaggggaaaagggcaggaagagagctgactttcatgtgtcagaccctttgctaaatgcttgcatacgtgtcatctcatgccgtctcctgtcacattcctgtaagaagtggaacatgttaggctatgaaatgaatattagtgtctccattctatgatgaagaaatgaatttaagtcacacatacaaagttagacaactaagaaacatgtgatttacgtttacactcctgatgccacaaatcaaaagaaaaacctgtgaatgttggcatcagacagtccaggttttgacttttgaactggcccattagtagctaaggaaagctgaggatagtttctgtgtcactgaaaacaatcacacttatctcatggaaatcttagtgtcctttctccagacctgctccctctctttcctgcatttgagggatgagatctacttttagaattacagagggaggaggcatttgaccctttttgaggtaaaaggagaattttagattaatggctaactttgtccttcgaatgtccccttgaggctttgtcagatttgattccttcctttggaaagataagaaaattgaagtggctattccctgcttctgcctggttagtcacagagtgaggcagtgacatgatgggaagcttctaacataacgaaaactagcgtgagactgagaacctgaagacttcaactctggccctagcttctctgtatttggatctcccagacaggcatccatctatcccacagtgagtgccttgtggtctgaaacgagatcaaaggtggaaaaagctttaaaaagctctcttcaaaaacaagaatgtcacaagaggctgactctcgagactgtgttcccctacccctgcctcctacagagtttcattcagcagaccttgctacctgccttcttcagggaaaataatcttgtttttgagtttatgtttaaactaaagttagttgattattttcttcaacccttgtttttcttgttcatagagtttcttaatgtcacgagcgttcacctgttcaaggagagatgggacactaacaaggtggaccaccacactgacaagtatgaaaacaacaagctgattgtccgcagagggcagtctttctatgtgcagattgacttcagtcgtccatatgaccccagaagggatctcttcagggtggaatacgtcattggtgagtgccatgtgcaagctccagtcttgacaccatgggttgcattgtagagagaggtgggtacaggcacagttgtgtgatttcctagtgtcatatgtcaacagtggcaggagctggaatgacatccagcccctgaattaccctgtgctctaagactggtctgtatagtgccaaatattgataacttgggcccacccaaggagaaaatctcatataaataaaagtaaaactggtataatgtgttgcttaactaaattattcttcctcaaacaaatggttttggcatcctatgattctaacttttatctccatgatttaattggtctcgtgctgaaaatgtttgtaaatcttagcatgcaatccaagtatgcattccgaaagttgattctgctctgatctagtcccatgggatggcccgtgaaaaatatagtccaataaacttcactaaacactttgtactttaatcacccttttttttttttttttttttgagacagagtcttgctctgttgcccaggctggaacagtggtgtgatctcagctcactgcaacctcttcctcctaggttcaagcgattctggtgcctcagcctccagagtagctgggaccacagttgcacaccattacgcccagctaattttatgtatttttggtagaggcagagtttcaccatgttgtccaggctggtttcgcactcctaacctcaagttatccacccacctcagcttcccaaagtgctgggattgcaggcatgagacaccatgcccagcctttaacctcctcttgaagattaacgatgcacattagcttcaaaggtctggggaaggaccatttaactttggtctggtgcttcttaaattaatttgatcatggaacccttttattaagttatagctattaacttttgacacattttggtaaacatttctataggaatttataagattatcaaggaaatacatgcacagagaagcaggggtggcacaacataggaaatctgcccatataatcctatgcacaaattaaaggaaaaaattaggcaatcaaatcagcagtcacagaaaggtacatggtaaaattcagcatccagttttaggaagagtttaaggggaaaaatttagaaaaaaaacacctcaatgataataaagattgcttacatcaaaacaacaacttttgatatctaagtggaaaaaagttaacaaatttcactgtaatcagaaattagaaagaaatgcctgctatcatcattccctttttaaaaagaagtactttaaaggttttagtaaatgaacaatgtaagagatacatctgctataaatgctggaaactaagaagtaaaactatatatttgctaatactatgattgtgtatgtagaaaacccaacagattcaagggaaaaaagcactgtattaataaaactttgtaagttggctagatagaagataaatatataaaaatcaataacttttatcttccccagcactaagcacccagaaatagacataaaaaaatttcacatgaccaaaactataaaatgtaggactaaaacctgaacacgcaacctatataaaccagctattaaatcttaataaaaaacatgagaaaccaatgaaaagtcaaacatgttcttgagtgggaagtctttctgtatacatttttagtctcccaaggggttggtcaaagaatacaaaatttcagttagatggaaggaatgagttttagtgacctattccacagcatggtgactatagttaataataatgtatatttccaaattactaaaagagtagattttaaatattctcaccacaaagaaatggtatgtgaaggaatgaatatgttaattagcttgaattaatcaatccacaatgtatattttgatcaaaacatcacatattgatcaaaacatcacatcccaaaaccccataaacatatacaattatgattgtcaatttttaaaagcctcccaaaattaatatgtaaatttaatgcatttccaattagaatcccagtggagttttgagttgtctttggctttggttttggttttttggacttgtataaaataatcttaaagttcatttgaaataataattacctggtgataaccaaggaaatcatacaaagaaataataagtaagagtattttctttctgaagcggctatcagaacatactatgaaaaatatttagtaggacataatagagaatccagaaatggatttcagtatatgagttaatatgattgttggtttcatgaagtaagaagaccatatgagattttatctgtttgcttgtttgtttttacataaatgatgcagaaataactgactctccaactggaagaaagtttaaaaattgaccctcatcttgtcccatatacagtagtaaatctcagatggaatgagtattaatgtaaaaaagacaattttttgaggaaatttaacagacttaactaaaaactggaaactctgacactgtagaagaaagcaagaaccatgtacagttatgtgccacatagcaacatttcagtcaatgacagatcatgcataggtgatcttatgagattctgatggagctgaaaaattcctgttacatagtgatgtcatagctatcataatagaatagtgagattacttatttttttaaatgtactgtagcctaagtttatagtgtttataaagtctacagtagcatgcagtaatgacctaggccttcgcattcactcaccactcacccagggctacttctggtcctgcacgttccattcatggtaagtgtcctatgcaggtgtaccattttttactttttatattgtatttttactgtactttttctatgtttatatataaatgtttctatgtttatatataaatacttaccattgtgttacaattgcctgcagtgctgtattcagtacagtaaaacacactatgagtctgtaacctaacagcagtaggctctgccatatagcctaggtgtgtagtgggctgtaccatctttgtttctatgatgttcacacaatgacaaaatcacctgcctaacaacatattacatcccgtgcatgacaacaaattcacgtttgaagctctggaccacagttctgctgcaattatgagggaagttttatctccatctttaaagccaaatatttagggtggggagaagaggagagggaagcttcaattctgaattggacttgtctgaggtttgaaacactctcataggccgttcagaaaataattatgataatggaagtcttagaaaaactggtaagatgaatgtcttagatcgggttactaggaaataaactctgagaagaagacttgtgcgcagaaagtttactggggagatctctcaggatcaacatctgcaagggagtggaggaatcactgttggacagagggaggagttgaactgcagtgcagacagggcccccgtggatctcaaggtgaactctagctatgggttggatcttcagagttgtctcgccttgagccaagggcatgggcctgttataccttttataccttgactggggttacagccttggtgtaattggttctctgtggctgagggtaacccctgaaagcaactaaatgaatgagaattgtcagccaccaacactcccaacaatgggaaaggtccaggcagcccaccacagcatccattacagtgaacattttaagtcctcttttcttttttacacaagaaatactattacttttgttccctcaataaaagagggggaaaagcatagctaatttgtttttgagataaaatctgtatatttttaaaccaacatgtattctaaacctttcagaacccatgatgtgtgcgttcagagttaagctgtattctagtatgtgtgggccattacagggccacatgtatttgaagattttctattataggtcacacacatttgaagatgtttcattgcccaacctgttgtagatacaagaaaggcaagtgacaaaattccacactctactatttagtgtagaaattaagcacacttcgaggggcgtggaaggacccatggtagaggatttatcttgatcagagtcatttctgcatctcacatcattcaggaagttacatgagagcctcaacttcatggctgccatagttgtaagacaggaagaaaaaagaacattgctggggaaataattctcttaaaattcagtgcctgtttcaataggactgaataaagccaaggaaattagattttaaggctaattgctataatgagaagagacaagtatagaacgtgaactagaaatgaaattaagtgcaaaggtttctatatacaggtgcacctcaatttccagaaactcagaaggtaaaagtgatggtttaaaaacgaaaaagaatataatttctattcatttttaaaaatctggcaacaccatttcaagagaagatccattttagctaacgttttacaatcagctaaatgtctaaacatttgagatatcatttactattaaaagtgaaccaaaatgtaacataaattaaaaaaaaaaacagacgagaataaatactttgttaaaaataaagggcacttaaaagaatctcggggggaggagccaagatggccgaataggaacagctcaggtctacagctcccagcctgagcgacccagaagacagtgatttctgcatttccatctgaggtatggggttcatctcactagggagtgccgcacagtgggcacaagtcagtgggtgcgtgcactgtgcgcgagccgaagcagggcgaggcattgcctcactcaggaagtgcaaggggtcagggagttccctttccgagtcaaagaaaggggtgacggacggcacctggaaaatggggtcactcccaccccaatactgcacttttccgacaggcttaaaaaacggcgcatcaggagattatatcccgcacctggatcagagggtcctacgcccacggagtctcgctgattgctggcacagcagtctgagatcaaactgcaaggcggcagagaggctgggggaggggcgcccgccattgcccaggcttgcttactgaaacaaagcagcctggaagctcgaactgggtggagcccaccacagctcaaggaggccagcctgcctctgtaggctccacctcagggcacagacaaacaaaaagacagcagtaacctctgcacacttaaatgtccctgtctgacagctttgaagagagcagtggttctcccagcacacagctggagatctgagaacaggcagactgcctcctcaagtgggtccctgacccctgacccccaagcagcctaactgggaggcaccccccagcaggggcacactgacacttcacacggcagggtactccaacagacctgcagctgagtgtcctgtctgttagaaggaaaactgacaaacagaaaggacatccacaccaaaaacccatctgtacatcaccatcatcaaagaccaaaagtagataaaaccacaaagatggggaaaaaacagaacagaaaaactggaaactctaaaaagcagaccgcctctcctcctccaaagaaatgaagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaagcaaggctcgagaactacgtgaagaatgcagaagcctcaggagccgatgcgatcaactggaagaaagggtatcagcgatggaagatgaaatgaacgaaatgaagtgagaagggaagtttagagaaaaaagaataaaaagaaatgagcaaagcctctaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggttgggttaccctcaaagggaagcccatcagactaacagcggatctctcggcagaaaccctacaagccagaagagagtgggggccaatattcaacattcttaaagaaaagaattttcaaccccgaatttcatatccagccaaactaagcttcataagtgaaggagaaataaaatacgttacagacaagcaaatgctaagagattttgtcaccaccaggcctgccctaaaagagctcctgaaggaagcgctaaacatggaaaggaacaaccagtaccagccactgcaaaatcatgccaaaatgtaaagaccatcaagactaggaagaaactccatcaactaatgagcaaaatcaccagctaacatcataatgacaggatcaaattcacacataacaatattaactttgaatgtaaatggactaaatgctccaattaaaagacacagactggcaaattggataaagagtcaagacccatcagtgtgctgtattcaggaaacccatctcacatgcagagacacacataggctcaagataaaaggatggaggaagatctaccaagcaaatggaaaacaaaaaaaagcaggggttgcaatcctagtctctgataaaacagacttcaaaccaacaaagatcaaaagagacaaagaaggccattacataatggtaaagggatcaattcaacaagaagagctaactctcctaaatttatatgcacccaatacaggagcaccaagattcataaagcaagtcctgagtgacctacaaagagacttagactcccacacattaataatgggaggctttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaacggctcaactacatggaaactgaacaacttgcccctgaatgactactggatacataatgaaatgaaggcagaaataaagatgttctttgaaaccaacgagaacaaagacacaacacaccagaatctcagggacgcattcaaagcagtgtgtagagggaaatttatagcactaaatgcccacaagagaaagcaggaaagatccaaaattgacaccctaacatcacaattaaaggaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctaacaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggataaatttctggacacatacactctcccaagactaaaccaggaagaagttgaatctctgaatagaccaataacaggatctgaaattgtggcaatgatcaatagcttaccaaccaaaaagagtccaggaccagatggattcacagccaaattctaccagaggtacaaggaggaactggtaccattccttctgaaactattccaatcaatagaaaaagagggaatcctccctaagtcatttcatgaggccagcatcatcctgataccaaagccgggcagagacacaaccaaaaaagagaattttagaccaatatctttgatgaacattgatgcaaaaatcctcagtaaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggccaaaactggaagcattccctttgaaaactggcacaagacagggatgccctctctcaccactcctattcaacatagtgttggaagttctggccagggcaattaggcaggagaaggaaataaagggtattcaattaggagaagaggaagtcaaattgtccctgtttgcagacgacatgattgtatatctagaaaaccccattgtctcagcccaaaagctccttaagctgataagcaacttcagcaaagtctcaggatacaaaatcaatgtacaaaaatcacaagcattcttatacaccagcaacagacaaacagagagccaaatcatgagtgaattcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccagtgactttcttcacagaattggaaaaaactactttaaagttcacatggaaccaaaaaagagcccgcattgccaaatcaatcctaagccaaaagaacaaagctggaggcatcacactacctgacttcaaactatactacaaggctacagtaaccaaaacagcatagtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaattggatcccttccttacagcttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacaattttacactgttggtgggactgtaaactagttcaaccattgtggaagtcagtgtggcaattcctcagagatctagaactagaaataccatttgacccagccatcccattactgggtatatacccaaaggactataaatcatgctgctataaagacacatgcacacgtatgtttattgcggcattattcacaatagcaaagacttggaaccaacccaaatatccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcactcacaggtgggaattgaacaatgagaacacatggacacaggaaggggaacatcacactctggggcctgttgtggggtggggggaggggggagggatagcattgggagatatacctaatgctggatgacgagttagtgggtgcagcgcaccaccatggcacatgtatacacatgtaactaacctgcacattgtgcacatgtaccctaaaacttaaagtattataataataaataaataaatttttaaaaaaagactaaaaaaaaaagaatctctaccagtacatctttaagagtgtttataacaagagacttaccaacaaagattgacttactgtcactcactatattagtcagtgttctcttgagggacagacctaataggatatatatatgtgtgtgtgtgtgtttgtacatatacgtgtgtgtatatatatatatgtgtgtgtgtgtgtgtgagtgttgtgtgtatatacatataaaggggagtttatttaagtattaatttatatggtcacaaggtcccacaataggctgtctgcaagctgaggagcaatgagagccagtccaagtcccaaaactgaagaacttggagtctgatgttcaaaggcaggaagcatccagcatgggagaaagatgtaggctgggaggctaggcccatctctccttttcaagtttttctgcctgctttatattcactggaagctgattagcttgtgcccaccagattaagggtggatctgccttccccagcccactgactcaaatgttaatctcttttggcaacacctaggattaatactttgtatccttccatccaatcaagttgacagtattaaccatcacactcactatatacttaaaaaaactttttttttaggttcgggggtaaatgtgcaggtttgttatataggtaaaaacatagctgtttcataaagcaagctattattatatttaaaatacagaaaaaataactttatacttagttgcttccaatttgcattcagtttttttgttgaggttgctctctcattccctgtgcctgtatagatgagctgagatatgttagtacactggagtttccctatgttgctgttctcagaacctaggtcatgggatttatttatgtgattctgccttctaaccaatttccttctctccctccctccctccctccctccctccctccctccctccctctctctctcactccctccattccttccttcctccctcccttcctcccttcctcccttctttccttcttccttctttctttctaaatatttaaataaatagggctcttggatggtgtgctgggctctgagtagagaaggtgagcaggagagctactgccttacctggccacggcttgatgagctgtgctgcaggggttctttgtgctttgataactgcgttcatgagttgctggcagagcacagctatctctgtgttaggtgggaggtgttaatgaatctgaggaggtgggtgtggctgaaaaatgccctgggagtctgcagggccttctctctctctcacctctgagcctgcagcctcgacaaatcatgaaaggcaaggaggggagtggtaatcacaggttttactaacctgtggctgagactgtgaaagcttgggagcagcttctggtgttaatttgctgttactttgacatgggcccctgcttttttgatacccagttgagggtgaaatcccaagctgtatttcttaccaggtctccccctcaaaacggcagaggtttcactccctgaggagccctccgaagtgacagtagggtccatgagcaagtttctttctccctggagttcaaccacaggaacctgggggtgtccaggtcagcgctttggagattctcctgacctttccctcaattctatgatggccctcacagattcaagcttcacatttctggttacagcagaaagatgaggagaaggatggcattagcatgccccaccccacttatcaggaaaacaaaagctttcccaggcacttctggcaatcgtttatgtttcatttgctacccttagctgtaaggcaagctgtgaaagtattccctttttccagtctcttcagaggagagggatggggcagagctgaaagtgggtgctggtggacccgcagtcatgtgtgctgggcatcccccctagctgggccatcctgtgagtataaaagtgctgtcctaatgctggcagccttgaggcaggttgttcatcacccgctcaagcatttctaggactgggtcaactgcacatgttctgcatcacaaaccctataaaacatggaaatgtcatcagcaacactttaatatctttctttcacttatttcttgagtagcatttatggaaagccagcggcggtgttggatggtgttttcagggtgggagtgacatggatgattctcatttgagatagcttgctctggcccacttcagggaatcagggtaattcaggataggagaggagatgatcagaagagagaggatgagaaccggggttatggctgcagttgtagacatggacaggagtgacagggtttgagaaatatttaggaggcaaaatctgcaggacttgtgttggggagtctgtgaggggtggaagggaggagggtcaaggtcgacttccaggtggctggcttatgtgactatgatgacagatgctagcacttccaaatgagataaagaatgcctggaattccagagggaaaaaatcgagtgtggaaaatgctaatggaggtagtagcttcattgataactcattggcactgttgctgtgcagaggtgctgtatgcctcccatttaattgttcaagcagccctctgggcattggactatggccatctccatttttcccatgagataatggttgaaaggattaagtaatttacccaggtcacacctggaaagtgctgggacctcaatttggacccaagcagcctcttctacttacaatgcttactacctccaccaagggagcctccaccaaggagatggtggaggtatgaatatgcttctgtttgaattgatgagtgtgaattacttgagggactttcaggtaaacctgtccaatagataatatgagtctgaagcttcgggaggaggtttgggttggacaggagataatttggatatcatacacacgtgggcaagctcactcagaaaaaggtaaatcaagtcagcagtggactgaggcttaagccctggggaaaacaacttctaaggcatcagtccagaaactagagcccctggaggagacaaagaccaaatgagcagataaacagaaggaaaataagggggttgcagtgtcactcaatccacgagagttgtgtgtttcaagaggaaagcatgaccaatgttattaaatataactaggagatgcagtgagataggaacttcccactggagtcaacagttgggggacactggttgaactcgggtagattccaaattttaatggtctaaaagtcaaggagatgtgaggaaatgggtgtagtcaatttggatgaatctttaaagaaatttgaaggagaggaaaagaaaatttgggtggtaactagagaggaatgtgggtgagaggaggggtgtttcaatttcagtatttgtttcaggattggagggactggaacatgtagcaggcagagagggaagaatcagtcaaggaagaattctgaagattcaggagggactggaggagaagcatagaggacaggggcacgggtgaggggctgagtaggaaggaaaattcctcatcttccaaggttgtcgagaaagaggtgaaggagggtatgactgccgtaggtggagaagtatgaactaagcctcatgcctgacaatctcaagttatttaaagatgtaggtggtgagcaggtgctatagggtcttagaggggcagatgagtacccttacatctgaaaacatcatccatatcctttaagactatgtcttcctatggattttgtttcagaaagtccaggtaaaatcatcatgctgatgtgtgattttcacatacataacatactttctctattgagaaatgtcttgccccaaactgtgcagcttgtaacgtgtagataactatttcttagcctatactctttcaactattttgtgctgcattttggtgaaaatagacagcctatttcatcattttgaagcaacatttatatagaatgtcatttcagatttttgctcctatgggtttctgcattgatgatcaacgtgtttatttttaagcatctctgtgaagtgactaataatggcatctaagaaagtaggacagtgtttcccagagtgtgttctctatgaacacctgtcatgtgagattctccttgggggaaaaaagttccatcatcaaatacagttggatcatgctgtgttttgtgtctcttctcatagaggcccaaggcacattaatatataaaaggctatgagtagacacgtagtcaaaaaatgaatcttgtttagcccaataattcccaaaattgttctactataaacactaccctaccacatttttatttttataataccattgaataaggtgcagaactcattccaggaaatgctgaactatagaggcatattacctctattccatacaacactgaggcaggtggctgacagaacttgaacagatttgtagtctatgtgttgtgataactttatatccattttttctttttgacacttaagattttgtgcaaacattgaaataactattaatttggcattcatatttagtaacttttcaaaaataattgttaagagtatgtttttatatttatttttcagatatttatttggcttctttcaaccataaagcctatttattttctttttgaatgtgcttattgaactcttatttaatactttgtatgtgcaaagcaccatattgggattagagtagtaagatatgttcatcccttgcctccagaggatttgttgtccagaggggacagtctgagtaggaaaggctgtgttcaatgccaaccttttgaacaaaatgcttagaagctactttggagggagtgactgatggcaagaatagttgaaagaatcctccagaaagtgctatttgaggcgggtctcaaaaaacgaatagaaattgacccaggggaatggaaattgtatacattctagaaaaaaaaaaatagaaaagttcagtggagcatgacattttggaagcacactgatgtctttgtatgacttgataagaagtttagatgtaattctataaacagccagaagcctctgtagtagcattttaggtagagtattaagatctgatttttttctactttttagattactatagcagaagtgtggaagataaattggaggaccgagattttgttagggacattagtaagagactcaagggggaaaaaaatctcactaataaatgataggataaatggatgctgcatgagtttgtatgatttttcccctcctttttttcccccaaaggaacttatgtttacttctataactagaagtagtaaaatgtgtgtgtgcgtgtgtgtgtgtgtgtgtgtatttgcatagtaaaatgggactcacctgtagtgaagtaacacactgtggtctgaggactaacaatatgccccagtggctggccctctgccatttgtaggccatctcagggatgacagctcacgtgattaaagggctaaatgaagccctttttggtggggaaagaggcggcttggactcaaggcagtgcccagtcagaacccgagctccaccatggatagcagtgacagaatcactttaccccaccccccatcacattactgtttcctcacctgcaaataaggactatactatttattttaaacagccatttatgggttaaaggagataatgtataggaaaccacttttttattctcacaataaactgggaggcagggaaggtagaaataaaacttattaaaaacatggaaaccaatgttcacagggattaagtgatttaccccaggttgtgggcaaaggatctgagcaaacatttctcaaaagaagacaccaaaatggccaactggcttatggaagaatgctcaacacctctaatcatcagggaaacgcaaattaaaaccacaatgaggtgccacctcatacctgttagaatggttactaccaaagagaatgataacaagccttggcaagaatgcagggaatagagaaccctatacactattagtgggaatgtaaattaaggcagctgttttggaaagtcgtgtggcagttcctcacaaaactagcaatagaactaacgtgattcagcaatcccacttctgggtatgtatctaaagaaaattgaaatcaggatgttgaaaagatgtatgtagtctcatgttcatttcagcatcactcacaataaccaagatatgaaagcaacctaaccaatggataaagaaaatgtggtatatagacacaatggagtactatacagcccttagaagaaggaaaattctgccattctcaacaagggtagaactggagagcactatgctaactgaaataagccaggcacagaaagatgaatactgtatgatctcacttatatgtggaatctgaaaaagtcaatctcagaaacacagtagaaagttgtttaccagaggctggggcttgggggcaaggaatgaggaaaaagaagatgttgatcaatgggtacaaagtctcagttagactgaaagaataagttttagtgatctactgcatggcttggtgaccacagtttaaaataatgtattgtatatttcaaaattgctaaaagaatagatttttaatgtcttcaccacagttacctttcttttttccatgtacatagaaaagaaaggtaactatgtaaggtaataaacatgtgaattagctgattgaatctttctacaatgtatacatagatcaaaacttcacattgtatcccaatagattccccataagtgattgtctattttttaaaaaacatctacacacgcacaaagaaaatgcttccaaaagcaaataggagggcattgctctcatgtcttttgtctcctggtggcaaagacaaccatcactgaacctcccaacagaaatacccagtctccttgttacatccattctgacagcttcattagtcacataggggctctgacaatccacaggccaagttctgcctggaattatttgcccatagttctagctgaagtgacagaaacagtttaatctcaaagtaggtgggattgccatccatattttggtgccagagaccttaccatgtgcttcctcagccctgccctgtcacccacatcatgtctgcagagctggagtttcccagtgaagcttatggtccctagggtaatagagtcgctgatgtctttgtcacattaagggtgccacacagagcacttatgaagggccatgggtatcggaatgagaacactcagaacatccacaaacgcttcctccctgactgcctcctgtgctttctcccctctttcctattcccctaatttgccttcacccttgctcctatgtctgtttctctctgtcttcacacttgtatcttatgatgacctctttcacttacaagaattcataaacgtggctcatttgcacccacataattgaaactgtactccaccagaaagcgctggtctgaactcagggaggacggactgtgggcattccctggcttttccacataaattctaagacattcttgcagcatatgaagcaagaggtgaaaaaggtgggggaaaatatttaatgaaaacaaatgtgcccactgcgataacttgctcttgagtctctaatctaaaaagagagcatgcaagtggaattacagcccactaaagaaaggatccaaatggactaaatattcttcatctttgccctccagttactccagaagcatgttgtaaggattaatgagggaataactggaagctctttgaactgcttcgtgatagttccttcctaataagatgacccaattaccagccttattttcaatattgcaactatgtaggaaagctaaattcttatggtattccttaaggaaggataaccttcataaaatgctactataacagcagccagagccagacaggtattacacaaccataagacaggctataaatagctgtacctctctcttgctaccctcttcaccctctttcttctcagtatcttggcctcttttctgatcttttctcttctttcttaagatttctattactttcatcccggcctgtctgtttctgtcttgctcttcctctctgtctgtctctcatgcatacatacacactgtcctgtggatgcacgtctaggtgttagtggcagcaaatgtactggagtcccacagcaccaaagtatgttagcagcagtgaatccacatggatctacagcagcctcaattcttgcctcctcataaggcaggagagactggggcaagttttagagcaggagtgaaagtttattcaaaagctttagaacaggaatgaaaggaaagaaaatacacttggaaaagggccaagtgggtaacttgaaagacaagtgtacagtttgactttgacttagggtttttgttcgtttttttgagacagactcttgctctgtcacccaggctggagagaagtggcgcgatctcagcttactgcaacctccacttcccaggttcaagtgattctcctgcctcagcctctccagtagctgggattacaggcacttgccacaacacacggctaatttttgtatttttaatggagatgaggtttcaccatgttgaccaggctggtctcaaactccttacctcaaataatccatctgaaagtgctgagatgacaggcatgagccaccgcacctgactgacttcaggttttacctgttggcatacttctggggtcttgcgtccctactcctgtgattcttcccttaagtggtgtgtctgcgtgtgcagtggcctgctagcgcttagaagcggagcatgcacagtgcgtttactagtgttgtactcgtgaccacttgatgcattttttccttaccagttgagtgtccctggaggaaggccacatactggttaaattccgccattttggctcttagtgcgcatgcctgagcccactcacccaactgctgaggttttattgggaagctgctgatcaccagtttcaggtatttctgtttattgggagactgcccttccctagcactggctgggaccaattattattttagaaggacagtttaacaatgaccgtcacctgatggtcgcctgccattcctggtgtgtgcgtagtgggggaagccctctcctcccctactcatgcctgactaggtacctactgtagcataggtatttactcatttgttagagaagtaatgggagttacccttgggaggtgggtctgaccgtttttgtgtctgttcatgagcatttctttagccttcaggaagctggggctggatgtgctaaatgtgctgcccatctctggctaaagcctagcttagccattgggatgctccttctctgcactgttggaggttttgctttggcttcttcaacttccttgtctatttcctttccaattctgtttacaaatctctataacatcttgtcccatgtctggttcagtgaatttgtgatgcagaaacctctgctgtgtccagcagtttgtgacaccccagagggggtttaagaggaatgaaagaccccatctctgtcttttttctttttgagttggagtctcgctctggtgcccatgccggagtgcagtggcgtgatctcagctcactgcaacctctgcctcccaggttcaagtgattctcttgcctcagcctcctgagtagctgggattacaggtgcccgccaccaggcctagctaatttattttttgtatttttagtagaaacgggatttcaccatgttggccaggctggtttcaaacttttgaccatctctgtctttaaagagcttactgtagttggagtgagaggaattccacaaacaatgaacacagtcagagagtatataattgagctatactgatacagttgccttccagaaatgtgtgacacgactggccgaagtgactctgggcagtcaagagcaagaggatcagctagagttgaagggtaaaatctcagaaaagggcagggaggtcttgagatgactcttgaggaactgggagcattccaagagggctacgaagtatgtaccctccatgcaaggaggacggcattcttggtagtccaggagcttattgttctgctgatgcaaacaagcttctagtgagaaggaaatatttccctgaatcaagtgtctggctgcatttggagtttggacaccactcagtttcaaggctctggagttgtaagaagcttgcagcggcaggaaaggcccatcaggcaggcccatgaggaatgtgctcccctcatgcaatcagtctgctgttattgcttggttagtgcccagggtggacaggggccttttgtattaaagcaattaattttacaaaaagaggaagaaacccttatgtttctgtgactaaaatgacggaaatgaagtagtggagacagctgcagtggcattttccatcaaacagcttttctatttgtgcaacatatttctaagtgatagaaaatgacacactctctccattacttcacttccatcatttccatcatttcaaccttttctaactttcatatttgtgaaacaaattgctttaaacatgtcaaagacatttgagtggagtgttagccaaattttaaaaataaagatgattcataaagacagtgcttgtgtttatagccatcaagacaaaatttcaggaaaaaaaatcacagtcctaattactgaaggcgcatgcataaggtaatcatatttggaagttagaaacaaatctctttttgctctctgcctcttttcccttagatttatatgggttggtaaacctggccttgtggtactcaatcatccttgcttcagtgattcactaagtaaccccttgcgagttgatttctccagcctctggatttatttgcattgttatgcaatgggtggaacacctcactgctgttctgctcctcagcagttagttctatcttctcttacagctgatgcttcttgaggggaaaggccaccttgtgtcttttgttagagataggatgttgccaagggtagggcaaccaggagggtatcccttagcatgtaactttgaagaatcaagattggtgctccacacaaagttcgttcaaaaatgtttctcttaagaaacttaaaaacctacatcgctgatggaaaaaaaaaaggaaggacatgaatatacaggataattgtacaaaaattgggtacatgtattgttgttgtttaaaagttttttttaaatttcgaaacaaactccactttacagaaaatttacaagacaaaccatacaaagaactgttttttcccagaaccgttattagagttgtcaatctgatgtctcgtcatccctgaatactttagtgtgtactacctatgagcaaagacattcttctgtgcaaccatcaaaataaggaaattaacactgatatttgatggtagtctaatctttagaacacatttgagtttttctacttgttcagtaatgtaccttatagcaacagaagctagtccaggatcacatgttatatttagatgtcatgtctcatgtctttagttttctttaatttggaacagattcataatcttgctttgactttcatgatttgacacttttgaacattacaaggcagtaatttttagaatgcccctccatttgggtttgactgatgtttcctcacttgatgttaaaatcaagtcacgtatctttcacaggaagattgcagaaatgatgctgtgttcttcttggtgcctcctacctggttgcacataacttttacagatcccattactgatgatgttaacttaaccactcgattaaggtggtggcacaggttgagtgcccaggaagtagactgtgaaattagcatgcaagctgttgattagggagtgctgttgggatcaactcctgtggaaggaagcagtattaggtagtgggggagtcaggctgcaatgcactcacaccaaaggcctcagatgaccctctgtgaaactctggagctgagatagctcttcatagtgctcctgagatgaggacaaagggatggggctttgttcctccatagtgatcagtcactggatgtgagccacccctggaatgaggtgtgaccctggatgaggcagttttcttctgctaaggcaactcccaaggaggcctgaaccaccaaggactattttctgtcatcactcccagcagctgaggataagcctgtcggtcatttccgaaggtgtcttgggcagaacatcacagagcccaacacagaggtgactgttggggttacccctgcaaagttattctttgttccttttatagttaataagtactttataggaaattatcttgagactataaaatcccatttattaccaaaattattattgatagaatgattgattaatacctggatgaatcctgattttctcttttaattaaataggttacttaaatcttttattatcattaaataacttaatgttcaaacagcctcgattttgccagttggactgttccaactagtttcagtatccttacttcctcatagtctgttacagtaagatgtttcaggcccgttttgagttttccctgcacctaccctcaaaataaccatttatctaaggagaaacatttctccaaagaactccacttcattttaatagaaagtagtatttagaaaccaaggtctagatcctaggtgtgctcattagtattttacctcctttcagtatttcccaattcaacctaggtatatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgaaagctctgcctcccgggttcataccattttcctgcctcagcctcctgggtagctggggactacaggcgcccgccaccaggcctggctaatttattgtatttttagtagaggcggggtttcaccaagttcgccaggatggtctcgatctcctgacctcgtgatctgcctgccttggcctcccaaggtgctaggattacaggcgtgagccaccaagcccggccgtcctccatacattttttatctttgagcttgtcatttactgagtcttcacaatgtgccaacagtgtgctctgtgtttgcattagttttatgttgctgttgtaacaaaatatcataatcttagtggcttaaaacaacaaacatttattattttgatataaggtataatgatatataaaaggtgtaatgacatcttaactgagctcctcctacctagtgtcgtcccttagggaggaatcagtggaattcagatcctgattattctggctctaaatggtccagaataatcaggatccgatggctggtcctggtatacctggtctgacactgggcctgggatctggaaaggtcttagaagaaattacattgagactgtaaaatcccctgaggaagaagacaaggtcttcagaatgtgaagtaaagagcatgccctctcccaattttatgcaatgagtgaaattctattatggcaatttattcatttaagatatgaaggaattattttctacaaagtgtaaatatggaggtaagaagaagtattagcactcttcttagacattaacattttagcaaaatgaatttattagactcttgccattaactgttagctgagaccagttcccttagaacgagttgccaaatgaccgttttcatggggagccatgcgatgttcaatgactaggtgctgccagggaaggctggcccagctgagtcccaaagtgaggattctccagccactccgcaaacagtatgaaactccagggtacatgcttaaagcactctggaatttaagtagtggcagatgttttagaagaaattccactgtgccactttccaaagcactggaattaggtgttatttacggaaggcaatattgtaccccttcaagcccacaaataaagaggtactcagcagtgacctttattaaaggcaaatcagtggggaacacatgaccagaggaaatgagagaagattggaatatattctaaggccttaaaaagatgtcaagaacaattgtgttcccccacaaggcatcattaggcaaggatggtccaacctcaatacggtttctttacatccctgtgtttcagctacatccgtggtctcctgtattgtttatctatgtcacttgcaaaaaactaggcttgaatacagttttttaaaagtgatgcttttaaatataagcggtaatcaacttatgaaggaacaatgaacatctatagtaagcaaataaacatccacacataaatatacatatgaataaacaaaatgcaaatgtgtgtcattctttctgccagtcctttgagttccatatttgttgtcatgtagttaataaagtcgttgacttcccccacggtctactactcttgctctgttattctcatgtggcattagtattatgaattaaattacagtctaaacttgcgtatttaattataaacccattgagcacaggaaatgtatcatatctcagcacattcaccaccctgtctcctccagattaagtggtatcactctgctcatcataagcactagtaaacatctgtttaaataaatgtttattgagtatgtattgtaaatatccacttgtaggttaatactagatggactgtaccatactccttagaatgttttctatgttgatttttgtttctccagtaattgctttaatctctggcaatgcaaactcatttaacacttgcttttatatattgcattcatatatactccaaagacaaacaaatgctttatcagaattaccagtgatttattctcattattgttgccattcaattattaacaggaattgactgttttagcaaaaatgtcatcagttggcctgttttgtttggaagacattcagctaaactttttcctttgttggctaatgacactttattttttaagtcagttgccatgattttaacgaaatgagcctttcttgtaaaacctagaaggctcattctgctcatataatggatggaacacaagcaaatgagcaaatggtgctttggctccatagacttgccatttgctgggggaaattcagttgctgtaggagattctttacggcatgtgttctgagctgactgagaacatgaaagagatgggtctcgaagatgctaaatgcagtgcatctggtcagtgaccttcatgttcagtgcaaagtgtgcctccccaccaagtccctctccaccccttgggcttccagaccccagcacgaggggtcagaaacccaagaaatatggaaacattctttgtcagttgaaagaattgcataacagttggggtcagatggggcaaaaagctgggtatgcagtttggtttataactgtgaaatctggcaaactacaataaattagacattgtgacaccaacatcctatttctctgtctcacatctctagatcttaaagagtttagccttcatggattgatagaataacacagtcttgtttaaactcatgccaaggaagggctggaaactgccctagaaacaatggtcatgtagatgaactttgtgcttctggtggccacattttttataccatgtcccctgagcaagtttccctatttccaacctccactttcctccctatttccaacacccagttccagcttttaggaaaggtacatagtgcagtaaatttaagcaaacacattgcctttcccagggatataaacatttcagcatcatctctaatttctcttctgttggtaggattttcattaccaacaagcaaagggggaatattgagaggtcaagagatcttcatagcaatcctgattgctctcctgcagtcttcacagaacaaccaaagtgattttttaaaagaacttaaagcagaccatgcctcttttctagtgactgcttttctcaatcagaataagatccaaagtcctacaaagccctgcttgatctggctgtctctgacatcatcttccatggtttcccctgctccaggaactttctcgtctcccacaattcccctgctcaggcactgtcacctcccacaattccctctgctccaggcgtctaatctcccccaattccctctgttcaggcacctcatctcccacaattccctctgtcccaggcatcttatctcccacagttccctctgctcaggcacctaatctcccacaattccctctgccccaggcatcatacctcccccaattcccctgctcagatacctcacctcccacagtttctctgcttcaggcacattggcctcctcaagcatgccaagtaccacctcccacagggtctttgcactgatgacacctgtcccctgatatttgcactgctcattccctcacttttctcaagtctcttctcaaatgtctcctctggccactgtctctaaaatagcacccccagctctgaccctctctgtcctcttaagctgctctagtcattttttcatagcacttgtctccgtttgacgtatcatgtatttatttgtttattgtccgtatactcccactagactatacactccattaatctttatgtgttgacactgctgtattctcagtacctagaacagtgcctggcacttaaatggtgcttaataaataacctgttgacgaaaaagatcctgaatcgtgccacagcaacaattacttgttaattgaaaaatcacaaatctatacatttggaaaggagtctttatttcttataaaaggttacagcctgcagagtgactatccggacaggctgagaagcacagcctctggcagaggctgaaaggtgggcacttcaagggaaaggaagatggaacaggaatttatgctgagctggttggccaaatatacatattccacaggttacaggaggagctatgaacatttatgaagagggtcttaatgtatgcatactgaataaacatgcatgttatgtgtgacccatgttcgctttggggtgagacttaacatttatatgtgcttcagttaggccctatacatcaaaaggtgaagcagggacaggaatgcattgtagtgtgcagcttcggtaaatcgtccagaaccagtccatggttgatagtctcttaccaggagaaagatgctgaaatcagtctcttacgcaatcaaaactgtagttgtggctggtggaatgtgagttagttagtcagcatctggtgatggatgaactgtagttgttccaacattgctcatcttgagaccagggcttgtttagctgctagacaaaaagaaaaactttgtggcagttagaacatagtttattctttaaatgcaggggttcatgacttaatccttgcctggtgtggccttgggtcttgtttataattatatattttattgccacagtgtcagtcttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggaccacaggcgcccgccactacgcccggctaattttttgtattttttagtagagacggggtttcaccgttttagccgggatggtctcgatctcctgcacagtgtcagtcttatgatctctattttaacattgattctgttcaattttgtctaaacagcaaaaggaaagggaatatagtgaggtgtgtaccacctcccatcccatcatggctgcggctcagtttttaaggtttctctggggtccccttagccaagaaagagtctgtacagttggttgggagtggggtggggataagattttacttttagttctcacaccttattcactacctgtgtggttatgctcagaaataaaaataaaataagtttagtaagatttctttgctattatagccatcagacaccatataatacggagaataataatttgttcagtttatgaaatgcccttcacacacactattgtttaatcctcatcttctggaatgccaattttacagatggaaaatgcactgagagggttcattagcctccccagtcacagctctggaccaagccgacctgggttcaaatgattgttctgcatcctgatagctatgtagcctagagctagttacttaagttacctgagcctcagttttcccatatataaaatggacataacccttaaaggtgatagagcaaatagaaactgctctagatttgtaagcagtgggagcttactggaggcaattgggtacacaagcgagtgaatgactaagaagccaaacaaacgacatggtgaggcaacccaggaattaggaacagtagaaaactgccaccacaccaggagctggaggcacatggaggaggaggtcccatcagaacccagaaggcatcagcaggtgctggagccatggaggagactcagactctcacctcaagacagagagagcacaggagacacaccctgacatctcccctcctcctgcttccaatcctctctttggccgaacctacctcgaagtcagagagcagaggagcgtgggaacatggcttcctgtggaacctgacagaagattctaggggtgcaggcaataggtctgagaacagccagtctgtcaataggtggagttgctgagacaaactataagtggttgttattcccgaatggacaacaggaaacacaagtccagattctttgactcctgttcctcctggtccttcggaattgaatgggcaacgtgaacaaatctgcagtgtaatgttatgctctgtaaccaactttgtctacattgtagaacattttctgctggttattttttcttaaagactaaaaatatcctgtcttctcttaaatgaggcaacacacatgtgggttagggaatttctagaaaactagcttcctggagtaaatttgtatcgcagttaacaacaccaggtcctaacttttggagcaaactcctcataaagcagcatgttctcccatgcttgaagcttagtctggaatctttgggttagagggaatgactgtttggttcatggctgtatctcacttaaaacagtgcctagggccaggcacagtggctcacgcctgtaatcccagcacattgggaggccaaggcgggtggatctcttgaggtcaggagttcaagaccagcctggctaacatggcaaaattccctatctactaaaagtacaaaaattagtgggtgtggtggcccacaccagtagtcccagctacttgggaggctgaggcaggagaatcgcttgaacctggaaggtggaggttacaatgagctgagatggcacccctgcactccagcctgggcaacagagcaagactccgtctccaaacaaaacaaaacaaacaaaaaaaataaaaaaaatggtgcctggcaccttgtaggcactgaaaaactctttcaagaatgaacaaaacctggggtcgcctatggctctgcccccctacttaatgccaacatcaaatacctgttgcgtctacttcctgcttccgctggcacccctccacttaccttcccccgagagtcagtcaaagacaccatcatgcctcccttgagcacttcagcaccctctgactggtttccttgctccactcttgtccctctcaaaccattttccatcttgcagacagactgatctttctaaaatgtaatctcaccagatcacttaagcttttcaatggctcctgccccatctccatcccctccctaggacacactctacatacctttgcacagcgttggaggtccctttgctttttaccctccctgggtcaaatgcttcttctgccacaggtatcctgagtttcctgccattccctttatgcaccatcctttccttattccctcagttggttactcccccagctgggaagacttttctctaccttttccacctttaagattgtatcccaaaaccacattctctgaggaatcttcttcaacttccacagacactgttagccacttcctcctctgggtttccacactgtgttcctcgtgaccagtagtcccaggaagaggctggcatgctgtaggaatgtttaaaatgcatgcacatttcactgaaggggcttcacagtcctctttctcagaaataagccattcttagggagaaattctcctatctcaatgctgttcgtattttctctgaagttcatgttatgttcttacttcctgtgaatgccactggcatcatcctgagacagggtgtcctcatgttcacattcctgccttggttagccatctaagtggtgcacttcttaaagccagggaccaggtagtcagcatcaggtgacagccttatgatttctttctgattcactcaaaaaacctagcacgatgctggtttcatgtatatcccacaaaattacgccttacatttactccaaaagaggctttaagtgatgtaggaagcactgaaagaaaagtaaaataaaatcaaggtagaaaagacaccttaacaagtacctagcttccatttgccaaatatttattgagcacctactacgttccaaacatcatgcaagctgctgggtatacaaagttaaacaaaactccatctctgtcttcacaaagtttccccccaaccctacctaagtttgcctgagctagaataaacatggccaggaaggtctcttttctttaggaaacatctggaaatatgtatgtaatctgccaatggcaacttagcaatggaaagggcggatttctacagtcctcaaagagatgatttgcttttgaatacttgtgtttctctcctcttagttgctatcatccatgatttctgtgcctttttgattgtttcttttttggtggtggcattttgtttttgtagctggtaacctggtatttctaagagttatttggtgacttattcccacttggtctcagcacactccctttccatcctaagactgttagcacaagttttgcttccttttccaaagcaactgtattcacacttccagcgctgccacatacatcatgctgttaccttcatacttcaagggcccatttggaaatagattgattattttgaacatgaaaggtgcgccttgggaaaaacaaatgaatcaaatggaaaaatgaattaacatcatgaaatttaccttctcagctgaagacatgatagattcctgtgttccttagagacagtcctcttataagaatgaactcttaagggaagtctgcaggtagatggagtcagggctcagcttaaaatgtgtttatataagaatggaaaacaccctctgaggaagaagcttagaaataaaaaagtttctttcttgtgaggggtgcttggattgaacacccagattgctgtgggcatctcattccagagcttctaacatctctatgatgatcttagtggggcttgccatttgcagagagctcagttcagcctcactgacatttattaggtaccgactgggtacaaaacactgtgacattctatgggagctatacagacatattagacaatgtcttcagttcagtttaacaagcggaatagatatctaagtgaataaggagaaaaatgtttgtttgggcttttctggcaaataattgttataggaaaaggggtctcgatgcagaccccaagagagtgttcttggatctcatgcaggaaggaattcagggtgagtcacagagagcagtgagaagagatagtttattaaaagctgctccattacaaagtagggtatcctcagaaagcaagtggaggaatgcgctgtcattgttttaagcttttcttacataggagtcttgtctatgtaaagactaaacaaagctgtgcttttgtgtgggtaggatgacagcatgacaaaatttattattctattgatttaaagaaaactatccttgacattttagtgtgtgagtatatcaaagcataactgtaattctcttgaaagtatatatcattatgggtattgggacatctggactttctgttgttgtaggagtttgtccttgcaggcattactaagttgtttccttagctgtcaacatcttaggaccatgggttttgactggcaaggaaagtgccttgctagttttcagatgcagttgatttaaaaaggttgtgaccctggctctcctacgttcgtttccctaacgatatggccagaagtcttcttattactaagtatagcatatgaggggcacagactgcagccactggacttacagatgacatgcccaaaagaggagagaagtgggagtgtcctgagttatcagcttctttattttggagcacgagagggagcagtgattgatagatgtgtctactcagtcactgataccaaccctccttgatggcaagtatgttcttccaggtcctaggcatgagagaggtggagtcagaacagttctattaggaacaatattcaaccatactgaccataccatgtgctatttgatgtcctttctagactacctgggaacctaatcaccacctaggacattgtatttttaatgtaaaaatatttcaaagccatcaactaacccaaaagattaattttttaaaaggcaatgaattcttctagtgggcactaccaatgcagggctttgcgtgcagtgggctctctggtctgtggaatgcattgaaaggttgagaggacattttccccagggtcacatagcactgaatttgagctgtggctagatttctctttcctatcttgtgaagaatactaatatcaagaaactgtgcacaaagctcaatcaagcctaggtagctaaggttggaaaagagtaacatcacaaatggaattaaagattttcatcttcttcctcctacatcccagctggggggattaaggtaggtctgtgtaaggagagtgaggccctcagtaaagggacaatgagacattcgaatataggcatatggtccaagcggcttttgccttaaaaacattagttttgtggcctcaataataattcacaaatggaagcaagcactgaaactaagagcatatgttaatttctagatcacttgggaagatggcactagtttttgataagtgtgaaaaaatgcaattggtaattataatatttcctcatgtttagtagtccaatttcaaaggctgcaattattaaaaacaaaacgggattcctttcttggatgctgtctttcccgatgtctttttcttgccctgatgtttttaacgcaaagttgcatgatttgggggagaaaaacacatctatccaggcattatatactctaggcaaacacgtgcatggaggttccctgtatggagccatgttttccatccagattgggccaaggatagctgatgggcagtcatggatgttgatggatgggttttcccagggtagctggattgtggtctcgtaaccatgccgactcctggggctgagaagggctatttagtgaaatgaaatactactctgtcacaacttcctcactcacaattcaatcatggagagtacttccccagtgctgtcactgaaatcattacattcagaattaaacatgggtgtaatagagcagtccctgaggttctattggcacatcaggttccacattcctaaccagctttcccatacaggaatatgaaaagcctgccaatcaggattctttttccttcctttggaattaatctcaccactccctgtccctgataacgcttccataacctgttcccgggccacgtggcatcagcgtatcagcaggattgctcagccttcaccctttggtgtctgacattactttggaagtcttcccaatgcaaatcacaaaaaaatgagttggcccagagagaccctcatgcaggttctctccacctggtcttccttctcttcactcactcagttgttacctcctttgatccacatttctggctcacacaactcttatccacggcagcatattttctcaatgtcccttttcctcatattcctttggactttccagttttattcttctcttgtctcctttcatctccctagatcccttttgccattctccaccttcctccacagaggaagcatgacatggagcaaagagaacaggcttccctgtccccagttctgtctccacttctgcctagctatgtgatgtgcacacatgacgccctcaccaagcctcagtttcccatctgtaaaaatttcctcacagaggttttgtaaggaccccaagaaataaaacttatttcctgtcactttatttgcatcactatgtgaactgccttggcaactctaaacaacttttgcaatcttaaaattgaatattttagccatgaatcataaaatcaataaaaagctacaaacttcctatgttttcaacaccccctgagactgtggggaatttaggcgactttaaggaaactaaaggttgacctactagtagtacagatgtttgcgaatagtttagaaacatatttctccttggaaggagaagctaggtgatggtattttcttcttaggctcaagtgttagacttcaagagtctgtaataaatcgctccttaaataaataaaatgtgaaatcctctaaggcagatgttggcaattgtttactgtaagggccagctactgtgttaggcgttgcagaccatagggactctgtcacaactactcaactctgctcttacaagagtagggttgtattgtagcacaataatacacaagcaaatcaacataactgtgttccaattaaactttatataaacagtaggtaggctgggcgcagtggctcatgcctgtaatcccagcactttgggaggcctaggcgggcagatcatgaggtcaggagatcaagaccatcctggctaacaaggtgaaaccccgtctctactaaaaatacaaaaattagccgggcgtgatggtgggcgcctgtaatcccagctactagggaggctgaggcaggagaatggcatgaacccaggaggcagagcttgcagtgagccaagattgcaccactgcactccagcctgggcaacagtgcaagactccatctcaaaacaaaacaaaataaaacaaacaaaaaaaaaaacagtaggtaagctacatttggcccgcagactatagttttctaaccattgctctaaaggatgaatggagattacattgatcattaacaactcagaaaatcagaaattatgattgaatgggaggtttcaggtgactccatgatgattctggaattattaaggcttttggttactaataaatggcaacccttttttttttctttttttacttctacaagttctcctgatggaaaaatcagtcagctcaaggttttttagtttgggatgaattggcctttgaaatagatttgggctttgataggtttgttggcaattggtaaacccatcctaatttcccacagatggagcagagaaggatcacttagaggaatcagaaagcccaggacaacagggaagtaatgataactaccaattattaagctgccctccccatcacaaactatgaccaccatgatctccattttgtagaagaagcaaagttttagttgacaggggatgagtgctttgcccgagatcacacagaagtgttagagccagctgaattgctttccccttagccacaatatctcaatcaacacaagtaacgtactttccttgggacattcacctttcttcagattcagaaccagagagcaaaaaagaaatcaccccttcttccttctgcctttactttctagtagaagttatacttaaaaaaaaaaaacaatttgccaggcatggtggctcacacctgtaatcccagtactttgggaggctgaggcgggggggaacacctgaggtcaggagtttgagaccagcctgccctacatggcaaaaacttgtctctactaaaaatacaaaaagttagccaggcatggtggtgggtgcctgtaatcccagctacttgggaggctgaggcaggaaaattgcttgaacccaggaggcagaggttgcagtgagctgagactatgccactgcactccagcctgggtggcaagagtgaaagtccttctcaaaaaaaaaaaaaaaaaatgagtgccccctcagccagcccctactgtgtgctaagcataaagctttcattatattataaaatctattgtctttttatttcccaaactaaactgcaaagaatcaagaaaatggaagctaagacaagtaagtgatttgcctgaagttgcaccagtagttaatagtggagtcagaatttgacatggttctcatcaactccaaaacattttcaactcacacagctgccatagagcttagaacaggccgactctcaaaccagatggtctgggttcaaatctgaactccactatttgctagttgtatcaccctaggtaagttgcttaatgactcttagtttcctgatttgtcaaattaggatgatgataatggtttccttctcatcttttgttatagggaataaaggggtaataagaacatggtaagccacatgctttggctttttctgtggaatatcagctctatgagcacagaagttattgtctgttttcttcactgttgtatccttagcacttaggataatgtctagcacatagtaggcaatatcaatatatgaatgaaaaatgtcagaagtagtctttaaattaggttatgactggattcaaagtcagcatgaaaaagcatagctttccttttgctttactatttttgtataacttggatttgataggtgaaattcaatatgagtctttgaagtcttaatttaaagtgtaacagtggaaactagtgattgtcttcattctttccatgttcccaacaaaagtagaagttagtacaaaggtgaagcttttaaaacaaaagtggaagttagcacaaaggtgaagctgaggttgagcacataacaggtacaaagagtgctttcagatgtacttctctagttttttgctattccccaaagtgcatccttacataattagctttaaaattcctttcatcccttatttttttttaaatctatcattaacacgtagatttttatctctaagtttatttttactaaacttgcatctttttaaatacgacgtattctgaatctaaatcagtatttagtgacaacagctgctgggaaccactgtaataaatgaattatgggtcccatttacctggcaagattgcctttgatgtctacacgtcaacagtgaaaggggttccagagaaaaacaaagcctctggtaaaaagggcaagctcatcccaagattgagtatgcacgaagagggagcagaaacaggagatgggtgcctctggaacaaacatgcttatgcaggtgggtttatggaggggctcctgagagggtgagtcccatgagtcttcaagagcattacttagatgccatggcacctaggcagaaaacaatgtttaaatttgtgctggatttacaagtatatgtgatattcattctgagtggtataacctatatccctaatagcaaagtgttgaagttctaatctttctcagtggtttgcactgtgtaaattattattttcattaagattaagcatcctcacagaattgcacagcagtaacttatgtaaccacctccttagaatgttctctctctgacaatatgcctaccaaagactcttttaaagatctttgaaattagtaattagggaggttacaatggagcactgtttgcttgtcttaatgtggaatcctctacatgctttatagaaaacaaatgaagtgaataagttttgctcttgaaggttctcctgcttacaatcaaagtaatttgcagacttgcctgatttgtatgtttcttcaagtcaagaataattctaatggattactcctgtcccttcagctataagataacagagtgagaacaaaaatggcttgtgaaatcaacctaacagagtatttcttctctcttctcataggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttcgaaccagtcgaaacccagaaacagacacgtacattctcttcaatccttggtgtgaaggtaagaggcagacatttagttttctcatttaaaaattcacctatttggcggggtgccatggcacatgcctatactcccagctctttgggaggccaagatgggaggatcgcttgaggccaggagtttgagacctagtctctaaaaaataaaaattaaaaattagatgggtgtggtggtgcacacctgtactcccagctacttgggaggctgaagtgggagaattgcttgagttcgggagttggaggttacagtgagcaatgattgtgccactgtactccagcctgggcaacagagcaagactccgtctttgaaaaaagaaaaaaaacaagctcatgtatttccaatacatctctttttgaaggggtagtaagattattctaaatacatatgcctctcctacatataccatctttaatgattgaaagagaaagatagaaaattcatcctccatgtgtatgaagataaaacctctatatgtgaagtcaatgctgctatacatttatttcgggattaattggagattgtctaaagttgcagttagttatttgtggagctattaattgcagttttgtaattaaaagtaattgcaaaaatcacaattacttttgcaccaacctcaccaacctaatatatgttgacagtataacctctgtacactattactctgtaaacaaattgggcttattaagcttgattatcaaaactattagagtctataactctgacttcagaaaaataaaataaagtcgacgctgttcatagtagaactaacctctctatccccctactttaagaacagaaagtctgtatatctaaaggattccacaaagttgtttatgtgcatagtgggtgcaaattttgcaaaccataactctggatgtgcaaagatgtagctgtactttaatataatataacttgatctctagtgctattttcagtcttcctttctgtctgcggcagaagcttaatctagttatattcaaataaaactcagtcaagttcaatgatttctctatcaattctgttttgtgcctcagtcacacatagcattttctcctcatcttcatctctgccctttcatacctctcccctgctcccacactttgtacgaagctgttttaagttccagaggcagatgcagatgttgcagcagcatcaatgtgggagagaccacttctaggtcctaggaaataaggcagtgaaagatatgaaagctcacatggggcaggagacttcccatggcaccctaccccatatgcactgctctctaacatcatccaaaatgagcccatattattgctgattttgaatgatccttgtatgtgaaagtcacatttgaatcagggttaatctgtcctagatatagataagtgcacaacaatatttgctactcatctagaacatacaccttggtcctactgatcttttctttgttttatatttatatttatttactttttgtagagacgtggtgtcactatgttgtccaggctggtctcgaactcttgggctcaagcagtgctcctgcctgagcctcccaaagtgttgggattacagtcatgaaccaccatgcccagcatggcttgggaattacctgttccactagtgttggcaaaaggcgccaagctattcctacactccctatacatccatcctcatcatattgtacccaacactcctatctatgagacagatattcaaggtaaatggtaacaggaaatgttaactgggccatgtgcagttcaaaaaatgaactcttgatagtaatcttaaaaccagatgtgaggcatttgcaactggttgatggggtgatatttacagagatgaaaaatactgagaggatcagagttacagatatataaattaagattttgaatatgttaagttggagataaccatagatagacagcagaaatgacaaataggtatgtgaatctggagaagaaaatcagagatatatatttgggagttatctgtacctagggagaaaatatagataaagaaggaaataggatatagtatctagccttcaggaacaccatcatttaggagtccagtagagaaggagtcagcaaaagagaatgagatggaagagtatgtaggaagcaacctattctaagaaaattgtatttaaaaattcatacttatcaatcaagagtttgttattgactttctttttattacaaaaagaaaatcctaggctacatataactgttcagaactctaggaaatttcaggaatgctataatttacccagactttggtttgtttgcaacttttctggattatatcatgtgtgtaaatgggatatgtgtctgcattcatttcaacttatgtgaccactcttcttgacgggaaaagggttagttaagttgcttgacatattaactttcaggataactactcaggaggtggacaatctaataaccttctaattgctgccttgatcttcagttgtatccatgatgagcagcttccagatacctctgttctgaaaaagtcacttaggtctggaggcgttcttgttctagaggctgtacagggacctcccctaggttttcagttcatggaaaggattggaggaaggtgggacaaaaaccagagaccaatttggaagctgtggtctaggacaaagatgatgataaactaaacatggtggtaccagtggagatgagaaggggttagattggagatctattttgtatttagaacaaaaattgcacagggattcaagatgagaagtaaagaaatgggaggactcaagaataactctagatttcttgttagaccaattgggttgatggcggtgccattttcagagctgggaaaactgtgggaagtggaggggaagcactgggggtgaagctaagagttacattcagaaatgttaatttggtgatgtctatgagacatgcaaatgaaaacgtcaagtaagcacttgaataaagtgaatctagaactcaaaggagatggctgagctagacatgtaaacatgggcacggttaggagcaataacggacacaaatgattcagggtcattaacaattaagagttgagacaaaggagaagtcaacaaaggaggctgagcaggagcagtcagtggagcgcaaggagatcaaaagagcccagagccagacacattgatagattcaagacagcagtcaactctgtttaatgctatgattagttgaataggataggggaggaaagtggccatatagtgtggaaatatggatgtcttcgatgatcttgaaaaggacggtttcactaaagtgatagagacagaagccagggagatggtcatgggctgtgttgtaaacaggaggcgagaaagtagagacggcgggagatggcacctttctcaagactttctgtagcacctagatgttgaagcgaaggtcaaaggagaattttttaaagacaagagagagtgggtgttattttatggtgacggagaggaaccaggaaagagagtttgcagtccagagagaggacggtggttcacagccttggctgcacgttgcaatcatctgggaagctttgaaactatggatgcttcagtcccccatgcaggcattctgatgtaattgctctggactgcagcctgggctttggggttttttaaagttctgcaggtgattcttggagctaaggttgagaagtttcaggagtgaaatccttgagtggttggaatccagggaacaggtgaagaagggcctgtgatgggtggggctatctactctctccagagacaggagtagagtagaagaagaggggtgcagattttccagtttaatggaagaagaatgaggtgattgccattttgtgactcctttttttttttttttgtcagtgaagtgtaaagcaaagtcatgtgttgagaagcagcagcaaggaagggcatgaaacgcttgatagggaagatgtgagctagtcatctggagggtagaaggtgaacttattacagggacatgccgggagggtgctccctgcttccagaacacagggcaaactagcacaatcttcttcattacttggcctgtggaggcccaaacatctctgcaaattctttagggatttctgacttcatggctgcctctgcctctaggagtcctactcacacttgtgctgctgcaagtgagaaacttgaccgtcaccttcaatttcaatgttggcaacaacaacaaaagcagccacacacaacatctgtgaatgcccagaccttaactgcagtttgggatggagggtgagagcaggaaggatgcactctgtggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggaacacatcagaatcacctggagggcttgttcagccacttctgtgcagcaccctcaggttgagtaggtctgaggcctggcctgagaatttgcatttctaaccagttcctgggagatgctgttgctgctggtcggggtcaacacttagcggaccactggtttcataataatcacgaaacaataaagctgggcatggcccccagagcagcctgcggtcccagctacttgggaagctgaggcaggaggattgcttgggcccaggagttcgaggcagccccgccagcctgtctctaagaagaaagaaagacaataagcaataactttaaaactcaagaggcagggccgggcccagtggctcacgcctgtaatcccagcacttcgggagaccaaggcaggcagatcatgaggtcaggagttcaagatcagcctgatcaacatggtgaaaccccatctctactaaacatacaaaaattagctgggcatggtggtgtgtgcctgtaatctcagctactcaggaggctgaggcaggagaactgcttgaacctgggaggcggaggttgcagtgagccgagatcgtaccactgcactccagcctgggccacagagtgagactccatctcaaaaaacaaaaacaaaacaaacaaacaaaaaacctcaggagattataatttactcttcttaaaatttcactggctctaccctgaacctaattccagtctctctcccttaccaccccttctctctctcctactgttctcctttattctctgaacttttctctcccattctgtcccaggagcaaattctccttccttaatgcagagggatccagtgagctttattatttttgttgcttgatctcttccaacaaccatgcttttgggccctgaacaccatttttttaaatgaagtgagagaaagagttcatctccccacttattgtgtggtttcccggcctagcacgcaaagcataacccaaaaaggggatgatatgatgaaccgctccccccaacacacacacaagcacatacactgtagcccagcagtcccctgcagttttatgcttgtgtgtgtgttaatgcataacaaaggattcagcgctatggcctggtaactggaaagtaggtcaaaagagaggggtgagactgtcgcccaagtgaaaaagatagcagaagataagaaggaaaactgtttccagaaattgtcaaaagacagccaggtgaacaagattgtggcccgaggtggcacaggatgctgggctgaaaattacagcagcatgcacagcacttattgataggagaatgctcagctgtgctcctgagggcccttcagcctgctttgcattcataggcaatttatcctccttaatcactaaatcattaatggggatcaatagcaatgccacatcagtgaaggcaggggtgcatgcggggagaataattgcttgcttagtttttagtttagtggtgctaaccgggcttcgggtccattctgggaggaaacccttctcctgggtgttagagagaactgtacccacaaaggcagcaggagtgagacgggcagttattatgaattcatcatgtttttctaactactcaggaactctgaactattgaatgtatttcactatttaaatatagaatgttccagtttggtagtctagcactagtgccagatagtgggtcctgaaagatttagatttctgatatctgtgcctagtactctggagaagcagtgagcagtatttttgattgggcatcagttacctttaagggatctttctcctcttgataagttgttcccccattccattctccatcactgcttttccctcacctcattcgacctcatatccttagcctctggcacacttgaggtttaataaatgtttgctgtgttgatttaataatcccaagtaaatactctaggttcgccgcaccctgtcattacagataacttgtaaatgtaatctcagaccttaccatcttgagaaaagtcaaaaacatatctggtgtgctgggaggagtgtgtctgtgggtgatgtgtgtgtggatttctctatctcttagcatctgacaccaaattagcatctaatatttcctttttattcaatgtgttttttcacttttctttaaacaaataaatcaatttaatttaatatgaagaaatcaatatgttcccaatatcttggatgcttttaacagcaaataaataaatatgacctgcttgtattttatcattaaattcatccttagccaatttgctttgtatttatataaggtctttttagcccctttcatacagaatggagtaagtaaccaagactggtgtcctcagagtaacaatgacccacattccttctcttggagactcttgagcccagaccagcatttacgccctcaggctagagccattcatccatcaatccacaaatattgatagtatgtcgcatcccatgcccatgacaacacaatgacctgtgcacagtacgacagtattatgtattcattcagaaaaattcaaagtcaatactgaattaggtactgggactatggcagtgaaaaaggcagacacaatcttcgtatagcttctagcaaggattttacaaatgagctcctaataaaaaactgattacaattgtaaaaagtactaaaataagtcagtgcacaagaagaacacaaaactggggactccgacctatttggggaacgaggagagactggccagtggcttagctttgcaccttggctagcacccagaacagtatttgcataggatagtaatcaaatagttggttaattgaatttttatgaagttttaataaagcttatggaaaaattttaacctttatttactcaatattcctcttaaataaaatagtatgcatcattcttcctagtatctgagtcattagagacttattatgctttttatgccaagcgaggatcatttagtgtggccctgtaatcagaaaggatcccagagagctcacagtaaaccttcttttcaatggcatgtaggtgaccccaggattgaggtgcaaaggtctttacaaggtgtttctagaaagagcatggttggaagtgtctaatgcagagacacattcacccaccaattcatgtggtttacaattccttccttgtagagtctcttatatgcttcaaagtgtgctcatagtcagtatctccctagattgtgtgtttggaaggtgtaatccttatctcattcagcctttcgtggtgcctggaattgagtcaatgttcagtaaatgtttgctgaactgaactgataatcaccattctgagaggcaaggagacgattattagactcagatttcaagagagaaagcaggttctgtgatgttacgtgcatttctcaaagtcctatagaaaattaagaaacaaactgaggctaaccctggagcatcctgactctgtcaaggtaagcacttatatttttaaaacaaaagccatcagtatctggcattgtgtaacaaaagaaaaaaaaccaatagatggccagccgagaagattctgtaatgacctaatcaacgtggaaatttctgccataataaataaatacataaataaataaataaattcaggttgatatttacaagatcaaatgaaagctttctctgggaaaaaaaattaaagcataccaacaagggcacaggctcccttagaggatatgtgctaagtaaagaagctctgacattttctttgtagaattgcttcatgaataatagtctatcttctgaagatatctcagtacactaaaaagcccttaaccagcaaaacaggcaaattagcacaaatccagtaaccttctcaagctggtgtgagctgtaatgcagcatgtttgtaaggaatgtaaactatgttgtactatgcacgcacggatgattgtgctgtcgtgagcactgtgggagatatactatcaatatctgtgaattgatggatgaatggcagtagcctgagggtgcaaattctggtctaggctcaagggtctccaagagaagcggtgttagtcattgttatttcgaggataccagtcctggcgaactactctactttatactgaaggggctaaaaggaaagaagcaaactcaactgactattgaggaaccatttgcttgtgcttcatagattgattccattccagtgttactagataggcaagcaacgtctctggagtggctatatgaaaccattttaggaaggcagtgcgtttggatccttccagaataaaaagctcagactctaaaaatgccattccttaatatgctcacaattgccaccgacaggaagttactcctggtatgccacagcacacacagcctgttagaatctgccaccccttttgatgtactttgtgatggaaaaacatatcatggtgacaccagtccggagtcacatttgctctgcagatcaagccactccctctaagagtgattacacactcccagcatgaatctttcctctttttagtggtgctcagcttttatataaagggggaagcaagtgtaagtgattcctaatcccctcgctctaaattccttccttccctaaatggtgactcattttgccttttggaagggccaaaccattattccttctaaaggattagaaacaacaccaaactctggtttaaactgttgaaagagaccatgtaggttagctgttctagcaccatagttttgtttaattcctgggctccctttgccagacttgagcctaatgaccaaggaaatggaacttgctctgactttgaaatagcatgtaaataagcagaaggaatgtatcagcccatgcaatgatgaatgatcttccttctcacaaagaggttatacagatactaaaatcagtaggctcagcatttgtttttacatgtttgttataaatccttaccttctctgggtcgggaggacagtgggaatgtcagagggtgactgaaatccaccccaaattttcttggcccactcttttcttttttaactacccttccattcccaccagaggaacagtaaaataaatgaggtcattattcttcactacatgcctcttgtaaattgttagtcagcctgcaagggtggttatttacgaggcattttgaaggtctgttctggtgacagagttgctctgggcagtggatggaggtgctgtgtcacactcaccaatggtgccatgtgtaatctgtttttctcagagttttatcgtaatggtggttgtctgccagaggtcacctacgatcaaagagttgtcagttggtccaaggtgcagccgctcctactctgggagctgtctagaccttatttctcccctcagtcctcagttaagtatagtttccagctcccacattccacacaagcctcatacacgtctaccttctaccagtccaaattgttgggtttctagaatagtgagttgtttgttagtttgtttttcctattagtcgagccttccattttactaagtgaagaactagcttcccctgaaacttagtgaaaccccaccgctctgaagctaaccaaaaatttaaaaacaaacgaaaacactatcaaaaagccaacagcaaaaatctccaagggcaaatgattacatttttctatttttgttagccttccaaacatagggagtttttttggagtttccatcgtgatacaattttttttaaccttgctttggacaactatattttaaagtgacagatctgaataaaaacgggaaataaagcactgctttccaccctcaatcttctttttaaaatcataaataaatttaaaattaaaatcgagccttcccatttgacttccttgccatactgtggattcatgataatgtctgcctgtttgaggtgagatttaattcaagtgttggaagggaaagggtggcctagtctggagctccagaactcctctctatcatgctttgccacttaaatttatcacttcccatcaatactaacgcaaagcccaaaggtaaatccttcattttcttggacttcttccttactctctaagctccagacatcttccccatctctcattctttcagtacacattgattgatttcctaccgtgttccaaggcacagtgttgggggctggggacgcagtcatccgatcctttggacccaagagccatggactacttagaaggcagcttattcaaatcctagcttcacaactcactagctgcatgaccttggaaaagttatgtttctctctgcctcagtttcctcatcagtgaaatggggctactttcctcacaaggatgttatgagtgttgatgagttcatgtgtcttgttataaagcacttagaaagttcctggccataaataagcagtataacaatgcttatttacatgctactacttaaaaaaaattaagaagtaaatacttaaacacatacttattcaataaatataatcattaaacggcaatgtccatacagtgggataaatgttacccccgcctccatagggcactaagggaacaaggtttaattcaatctgtgctggaaaggaaagggttcagggagacttaaagaaggagaaaaaagttgtgttgaaggactctgataataaaaaagagcacaaccctatattgctcttaaagaaaaactaatgcacaaaagttggacttgttaatctctttttaaatgggtagcttcacttaaatggaaacacattttagaaaataactttatctgatggaaaagtctcattatagaaataaaaaataataaaagcataaaaagagctcaaagatctacaaattagagacactaacaattaacattttgttgtaatgtcatccatttaaagtattttcagtgcttttcatttttaattggcaattaattgaatatattgttcttttcaaataaacacacatgtacatttacatggctaaaagaaaactttccttttcaccaatcttccaatcctagagaatccccagggaaaaccaactttaactgtgtatatcattacagatactttgctatcattttatgtattgatggcatatatatacctagagaatttaggttttttaaaaccacaaaagagattgtgtcaacctgttgctctgtacctcattttctcactcagtatatcttggagcgttttctatatcagtacctgcatcttctttttaatggctgcttggtatggtcatatcatgttgttttggtgttttgtttacaactatttggattgtttcccatttttactatagcacgttatgccattttgaaggttgcacatacattttgtacaaatgttactgtagaatagacatctagaaatagcattgggcaaagtgaattcacattttaaatttgcatagatattgcctaattacccttctaaaaggctgcagtattttacactacagccatagtagatgagagtatccatctcttcataccctcattggcactggtggttaatcatttgttttaatatttgccgatatggtaggagaattatggtatttcattggtatttcatggttaatttggtttttatgtctctgattgttagtggagttgagcattttttcatatatttattgaacgttatgtttctctacctgcttatatctggaacatgtcaggtgaaataaagatcgtcagggagagacacacatgtgcctcttaaatctatggatacagtttgtatatagtaggataaagagatcttactgacactttttttcttacatagataaccagctgtcaaaacaccacgtattgatcagatctatttttacctattgattttaagggccatctttattatttactaagatttaatacacatctagctccttccatatatttgtccattactgtgctaatgtcagttttaagtgtagctttgtttcagttagctataatcacactaatgctacattaaaaagaaccagaaaatcttagtggcatacaacaataagcacttactcagggatctggggcttggctgggattgggctcatccagactgggcttgactagccagctctgcttccggtgggaacagctggagaggatccgtctctccctgagagctccggagaccctctgctctggtgcctctcatccttctttgaccagtgggcttgctgggtcatattttcctcagggtaacagcagatttgtatgatcacatgctcagctgcgcagtcatattttagacccctacttgcttctgctaacattgcttctgctaacaccccattagccaaaataagcctaaagttaagagaggatattccacatttagagggaagaactgctagttacatggcaaagggcatagatgcaggaaactataaattggggtccaaagtttaatttacctttgggcaagtccttcaatctttcttctttttcaacatattagtttttggctattttctctctctctctctctctttttttttttttttttttttgggacagattctagctctgttgcccagcctggagtgcagtagtgctatctcggcctcctgggctcaagcgattctcctgcctcagcctcccgagtagctaggattacaggcacacaccaccatgcctggcttatatttttatttttagtagagatggggtttcactgtattggccaggctggtctcaaacttctgacctcaagtgatccacctgcctcagcctcccaaagtgctgggattacaagcatgagccaccacgccctgcctggctgttttctttcacattgttttttccagataagcttttgaatgagcatgcaaagttccaaaacttctgagtagaagtttggttgggttcacattggtcatatagactaatttgggtagaatttatatctttacattactgaatgttcacatccaattggaaacattttgtatgtgttcattttgtatttcagttttatatcttttgacaaagttaatttttcttataaatattttcagataaactcaaaagcagaaagagtagcacaatgaatatctacttatatgactctcagagttaatggttatcaagattttgccacatttgctttatctatcccttttttccttattttttgccttagcattttcaagtaaattctagtaatcatattattttacctgtacatattttagcgtgtagctttttaaaaatagacatatatacagtatacatagatacatatgtacatatgtgtgtatgtatgtgtttatgtgtgtttgtgtataattattgcagctaatacaaatcaacaagagctccttggtattatctaatgaaccatctttaattttcccaatgtctaaaaattatctttttagttagtttatttggattaaggtctgtagattaaatttggttggtatgtcacttaaatcttttcctctagagtaatcctcttcatctgtttcttcatgccacaaacttatggctgaaactgagtcattttttatgtagaactttccatattctgaattttgctgattccatcccccggtgtcatgaaatatttttctctaaccactgtgggatttttttttaaccactgtggcattttctgttaagcagctggttagatctacagactctgtcagattcagctccaagtggcattttttttttggaggaaggggcaaaaatatttcataagtcacgccattgcttcctaggacattcatcctggcagaagatacatatatttaggtttgtcaatagtatctggttcacgttttatcagtctcatccacccgttacgaagttctcttcttaacgaattatttctgcctcaattcgttacttcattagggattgcaagatcgtgacattctaattctaccattccttttgcatttattataatcaattatttcgttaccttgaggtagaattcgtgtaaaaacgcttagatgcctgtcccaaacacacacattttcctgagtgcgatttacacttgtagggtcctgtctgtgttaaagatgctttgctgctctcccaccaggcctgggaataagtaccagactgatgatagacggggaggatgatcctcctgaaattctagccacagggaagaaaagtccttgcaatgaaagacactggccagggaagctggttggacacacacacatacttgcacattcacaagtatctttcattaaaaggagatgacctactgcttccctcctgccagtgatgggccacaaaacagacatgacacgtgggccttctcacgtgtcccagatttgttttaaaagtcattttcaattcatctagttttctattaatgttaaaaggttggaaattatattttaattagtgttagagacgtacatcagcatcatagaattctgaaactactgatgcaacagaatcataaaatgtttaatgagacatatcaatttaattctgctgcttggaacttaaagagccagagttcgtcagcattttgctaacaaatgtcatcatttacagactgaatttggtgctgattatgttcaccattactaaaaatattgggaaatgagctatgcttggtgaaacaaagggcattttttaaaaatttggctgattaaatgtagtttagaaacaaaataaacttgcataaacttgcaagtgtttggaaacagtctggtttggtaatagtcactatgtttaaaccctgatgcagatgatgctgtgtatctggacaatgagaaagaaagagaagagtatgtcctgaatgacatcggggtaattttttatggagaggtcaatgacatcaagaccagaagctggagctatggtcaggtgagccacttaaaatttgttattgtcaaggacatttttacttcatattttttgtcacatgtatccctacaggatcccatatatcgatattagacaagcacaatttcctgctttttaggatctgagactccaaggcagagagcataggagtagggactcataaagacaactgcgtaatttatcagctgaaaccacatatctctgggtattacagtgttacagaaatgagagattccatgaataatgtggcattctattgagaaatgctttggccacttagaacagtgaaatctcattagttcaacctggcttataaagaaaggtattttcaaagtgatgcaaagaatactgcaaggggtgtgcccaattcaaagaaatagcttctttttttttttttttaagtgttagcctagggtactgctaattagaaaagagtgttatcatttcatcaaaggaagggccactgagcttttacatagaaagattttatcagctgcaagttgattgtctagacacaaagtagcaaatggcatttctttaagatgttcagtcattcaaactatttcagtttggtatctttaacaatggagcaaatgaatgatattttaccaattttccataaatgaatgcatgtcctgtgatttcaaaatgatttttaattagcgacacaagcgggggcgaatgtcatttctcaggagttttggctgggatggctggaactgtgcatcattgcgctgggcatccagcagggagttttcatggaatctggtggtcacagggtactttcttggctccggatgccttgctttgacttccatatgggatctccctgtgttccttacccactgctccagtacccgtgttatcctgcctacctggctttgtgaacagcttccctgactccggagaattacatgcccagtgctcaggcttccccgcctgcatttctaatgtcctgccaagctacaagctagttggcaccccctgttcttggattcctgcctgactccctggtttcaagccatcccctcctcagtgacatgcaacctttgactatactgcctactgcctgatgcccttgtcttgggtccccaatttctagcctttagcctggtgattctatttatggcccaaatatgacaatctatagatagctaacaaggggaaaagtcatcaaggtgggcagcaaggaggtctggaaaagtgtcccaagcccagtcagggcactcttcgccagcttgcctttgggtaggcaccctggagcacagtcacttgattgtatcttctgccactcaaagaggctattggtgtgtatcctttggccagaataaccagccaagcatgtttacagtgatgcagggaatcaatccgttctatgactatttccttaactctccagttagttgctatcctgcccagcaaacacagctgagagaagctgcttaataagaaccaaaatactgagctatttgcatacctgaagaactagtgcaattacccattactgcatccatcctgtcagtttgggatacacccagagtgggtattctaactggactgaataaagaattgtgtggtaattagccattatgattgtggtttctgtcacaagcacttgggtggatagcacacaaggtttctctattcaggaaaatctcttactacagtgaggtacagtataggtaaaatcttcctgtcttgctatttgatctttattcctttttaagaaaattctggtattgcctgtggctagcagttctttctaagaagactgaactggtaccagactcctcccttgatagtgtaatctactttctgcagccttctgccctctccttgatcctggggtccaccttgtctcagaagaggggaaaccttagagggacagtcactatatgaggtctcctactattttgggtgcaaactaagtagtgtgaagcaccttcctgtgatacacctgagagctctttattttctaaatgcacgaggattcacattactttcgaggtcctaagactctggcctgactttggtaaatgattcattccttcttcttgggtacaggagccaatatgttgaaaagaccttctaaattgaatcattttctgaagaacttcaagtcagcttatgatccctgagtatatcaactctctagtatttctgtttatgtttctggcttgcttttatattcttattcactttaatgaaaaacaaaagaagatgtctcattccttctactttaatatttcatactaaagattatgggagatcactatacaggaaacacacatttctaaacattaggttgtggtttcatgttatttttcatcagagaatattttgcttgcagagtgaacactagtttctctttgtttttctttctccaaatagtttgaagatggcatcctggacacttgcctgtatgtgatggacagagcacaaatggacctctctggaagagggaatcccatcaaagtcagccgtgtggggtctgcaatggtaagcagcaattactgatacctaaaatctgttacacctgtcatttgcctcagtatatatgccagttcattaagagctgctgaaatgatgacttacacttaataaactttcatttgtaagattctagcttctgacacccagttatagctcctggaattttctgagcttatcatgtgctataaaacaaaattatcgtctcaatactgtatgtttctttggctttagaaaacaatgatagatataatgatactgtagaccagttattcttaagaaccccttgcctagagactgaggagtgatcatgacaaaaatgtcaatgactataatcaaacagttgatcaaccaaacatcaaggtgcacagaagatgtgcaaggcacagcttttctcaattttcacactgatagtaagagtgaagaaatgaatggctacatctcatcctaactcctgtcacaaggatgtgtcactgtagggctttctcacttacgaagtgggtattgattctttgcaggatcctgtgtggtaagtagggcagccattactcatgcacttttacaagttaggacacagggtaaggacagctttcagtgacaaagccacagctagaactccggtctgctgacttcaaatctagacattttctacttttcatgccgctctctgcaggatatcctaaaacaactttgagaatgcagagatcttgcagtggaacaactttctgagaaaggagatagaactcccatgagtgggaagggtgggccaggcataggacgtggattaaatgggatgtccaggacccatgcagtcctggattatatcaatgtacccaacatggagagccagatgttggtacagagaagtagacccaatctggctgaagagtagattatttctgaagaaatgttaaactgggtggtatttcaaacaatcaaagactgaaaaaaagaaatacttatattaccaatttccctaagttttctaagaaatcctctttttgaaagaatgttatgtttgagtttggtttgtatattcttttgagctaaatgaaatcaatattgttaatataaaaatattagactgtgaatgatatgaaatataatttctggttagcttttaagaatggtggcttttattttattaataactaagctacatgtgaatttaagaaacagcagagcataaaaagtaaaaatagaaaccaacatgtaaaggcagttttgtttcctatgcatttacattccataatgggaagccaatgaattccaaagatttgggggaatgttgaatttgggaaatgtttaccaaagtgtcatgaccgtttataacaaatatattagacttgcatctgatcactatttttactgtttcgcccacaagatttctctttttcttctttgaagttaccataacaattttgcagtaagaaaggaagcaacagctagcagtggttaaatttaaattaattccttcttaagcattctaaaatggcacactcatcagcataagcttactcacacactgtgtgtacttttacgcacccagaagtcagaaatcactgcctagcagaagccagtgcaaaagagaagcagacaggaagcagttaacctaatgtgtctgtggtggcagctggctaagcggaagctgttaattattgaataagcacacatactcctaatgcaaattgccctgagattttattaatcatgtaaagcctatgaagttctaagtttgaaaatttatatcccaattaaaagatttaaaactagacagagaaaatccatttggaaaacggtttggttttatttttggagggggagaatttgggtgttaaggggtagaggtcctgacctgagacattttgagcaatatttccatttccgtcatacccttgtttatatacacaaaatattcaatggttttcaaaaacactttcacctctattagctcctttaaaccttagaatacctctgtgaatctttccaaaatctgttccgttttaataattttaaaagctaaaatactgagcctccaaaaatcaatttaaaaaatgacacagaggaaagatcaagtgttctttggtcattcaggcagatactctcccgttcacaaatcctggaaatctatcatgaaatttctgaatgcagttaaacaaagaacaaagacaaaaaaaatctttaaatttctcaatgaatgatttgactttattagtatgaaaagatgtgcctagagagcccacaagaaaatgttctgaagttgtggactcttagccagaaccctgttgcagggcgacagagctgtgtgtgttttctcaggggctgggcccaggcctcacaggtaaaacagaggctggtgcagagttgttctgaattcctctcaaacacctcccagcctggtcatagaggctagaaatcccattcgcaggttgcaaatgccagagcagcggtataggtggcatgtggactctccagaagaaatagcacatagatctcagttcatccccaggtgagagtgaaggaaggcagaactttcctgagggcacttgctgctgggaaacagtgaggatgagcagaccagtctttgctgggtatctggagagagtggagctgggtggggacaagatgcagagcacacgactggggccccaaagacaaatttgcttactgtggtccaggacaagtctagcactgaaggttggcaaggagttttcaggcaacaggtgggtgcatgttgaaaaaagcaccgataacccaaattgtgcaaactttcaatcataataagaatctgaatttgggccaggaacggtggctcacgcctgtaatcccagcactttgggaggccgaggcgggcagatcacctgaggtcaggagttcaagaccagcctgaccaacatggagaaaccctatctctactgaaaatacaaaaaattagccaggcatggtgatgcatgcctgtaattccagttactcaggaggctgaggcaggagaattgcttgaacccgggaggcagaggttgtggtgagctgtgatcacaccattgcactcaagagtaaaactccatctcaaaaggattttaagtgcacaatccccagataaaaatatttattgttcagtatatttatatttattgtatgtgaccttgggtaattgtttgttgtagaaggttgtcctgtgtagaatgtttaacgacatccctatcttctacctgggggatgcaagttgtcataactgttcccttaccagttgtgacaactcaaactgattccacatattaccaaatgtctactgggggtaaaaatcacccttagtgaggatgacagcactaaacccctctgtgactcagtttctccacctatggaatgtaagtaacactctcttctcacctgcatagcgaatctgtcttcctaactcactcaaaacctgctggttttcatccttgactgaaaagaaagtgaaggcagcatcatatgggaagcgactcagctcgtgtcgagggattggaccttgattctggttgtgctattaacttactatgtgacccagggtaaataactcacctctgctggcctcgcatctttgtctttaaagtgaaattttgtctctgtactcaaaccacattggcagcaagaatactcttttattcttcaaaatagtgctctcccttcttctattttttcctttatacattcagtaacttcccttgttcttatattgagttgctgttatttcactttgatgtaaaagtaggaaaagttatgacaatctggacagcctggggctattggagtttcccaggagaaagcaagtccaaaatcctgtattctcatcatctagagattaggcctgagatattataaccttacataagctaacttttgcttaggctcctttaaatactgagtggtgcattttaccaagctatactgcagattgatttaagagagaaaagaaaaaaaagagaagcaattagaaaaaatgaagaaacttgcccacagttatacttctccctttaaattgcattgcttgattgctgctttcttttcaatgcatttctgatgtgacagttcccaccaggaaaattgccagagaaagctaaggagaatgcttaactttgtgccatccgaacacttacttccctcacatggcattaataaagcattctattgctagccccaagtttctgtgaataagccagacatggactctgagccctgagtcagactatcaaagaaggtgggccgtgacatattgtgacaagggcagcatggttctggggaaaagggaaggctgtgcaaccacctggcattactgcggcgtggttacctgtctatgcctgttcctgcctcccgactgataggatctggcagcaactatgggcagagaatttcccccaaggagatgcagctgcttctgcaaaggctgccgctactgcagataaaggctcgttattcactgtgacacacctacatgtaccacctccatccatatttgctccagtgggtcaaggcattaccagtggaggatctgtgtcgaaacacatgctgaaccagcgtgtgcaatggggaggactctccaagagtcttctgggtgaggaagcagaagcccttggaagtggtgtccctcactcaaagtcacacagcaaataagtggctgagctgaaaccagatatggtccttactctcagatcatattaccttagagggccactatcaacacgttattgccaataacacaataattatgtaagattgaattgccatttcctagaaaagaagagagccccaagggaatggagcccagatgaggcaaattattgaaaatggggaataagtgaagaaaggtatcaatcagaggattctaaatagccataggcactggggccctggagaatgagcttccaaagacgatcaggtaccaaatatgatatgataatggtggtggtgtttggtggtggtggtgatagagttagtgatgatggtggtggtgacggtggtggtgatagtgattgtgataataatggtggtgatggtagggtgattatggtggtgatagtgatgatgatggtgatggtggtggtggagatggtgacggtgatggtggtggtgatggtaggagtgatggtggtgggagtgatggtggtagtggtggtgatggcgtaatgtggtggtggtggtgatttatgatggtggtgatagtggtagtggtggtggtgatggtggtaaaacactcagtatttactcatttgtttgacaaatgtttatggcaatctaccagtctgaacactggagtacaattgtgaacaaaattaagtttctgccttcacaaagcttacagtctaacagagaacacagactagtaaatagaaaattttagctcagcatggcaaattctgtgatggaaataagcatagggttgtatgggaaagcaaatctctcaaatgtagctcaaaggtttcccaggactaaacattggatcaaaagatagaagaatgtctgaggtcccacagtaattaaccatgctattatttgaagaaaccctttctccatggtggaaattatatacaaacagctagtcaccaaaagcactgaagaaaaatgtagtagagggttatttgctcttctgggggcttgtttgttttgcaattcagaaaactaaggttgacacaactgaagtttattccataggatctcaacatttacagttacttgatccatggtattctgattcagttgtagtaagaaaaaaggtaatattaatgagaaaattaggaaagtaggaggagagaaaaaaacgtcaatatagttacatatttttaaatttcagtgtttgtactgctgccatcctggactatccagcttcccttgagatgtatgcatttatttttaaccctggccttttgctaatatcgaaccacaatgccatcattaatccccattaatactttgctctgactatgccttttgggaactaactcatgactaaacttttttaaccaatcgatgttcgatgtactctttagcattgtaaaaaaatcttgaacttcagctagtaaatcaaactgaccacaattcggagtaggtcctggatttttctaggacacagtacaagatgaatgactgtagacctttgagatgaaatggactttagtgcttctgatcctcatgcatctgtgatcctacagataaacagaaaataaagttattttccctttgtccatcttttcctccccctctttttgtcccagtatttagaaagatttttttctttccatgcatgaaaaagacagtaatgacataactacttttatatcttgccaagcagctcctcaaggggttaactataaaaccatgttttgttcattttctttcaattgtttacttggtcatcttataggaagcttcacgttgagcaaacctcttcatgcaacaaaccttaattataaatattcagattacatttaaaagttcactttgattagaaatttcacacctgagtcatcccaaatgaactgtaaagacagaaataaatatataaagtttgtatttatttctaaagtttattccttgatcatacagaccagtcacaaggtactttcgtaacagttttattaagaaaaattttaattacaaagcaatatctaacccatcctttggtttataaagcagcttaaacctctttttttggagtgaacggtcgtagatacatctgaggacccaggtgctcaatgggcattgtccttggcatttctaaatcaccaaggaactttttcacatttacccatatggattttaatttttgaaaaagttcatctatcaaaacaaatcatgattatgtaataataccttgttaccccattcttgtgtcagatttatataactgccaatgggaacttctaatgatggtggcggtggtggtaatcatctctaccagataatgagtatgaccacactgaatatgattcggtgtcactttgtgggggtaaagatacaacttccatctggtcttttataaaagcgacaacagcctacctgcattactaacccacagatgcctagaggtcaaaattccccaggtggtgaccactgccagatgtaggttccatcatggacttgagtctccatccagagcttctgggtctccaaccctatcagcttttatttaaaagtgttattgtctctttctatgattcatatcaggaatgaaatttctcagtttggaacagcagaaaaaggcagaagcctccggtgttccttgcaacctttccaattgtaacgcatatcaattagtaggagctctcggggtgacaactttgggagaatccactgatttatattaatgaagagtgttactgtagtccaacagagtaaagtactaaattaccaactctaaaaagattttttagaaaaccattaaagttaaagtcaaggtatttctaagaatgaaagtcatttctatgattctaaaatgacccagggaattcaatgatgaatgagaggtacagactcaaagcaattctctaatgtattcaaagtaaacaataccataaggtcaccttattcaccagggattttcatttctgttcattgaagatttttaaaaaattgacagatatattggaagccagtgggaaaatagaatttatctaacagaaagtatcttcatagccacttttgagaaattgcataaatccattccataaataaccaaagtgcaggtggagagactgaggcatcaggaagttaagtaactttatccaaggttgctggtagcactgggggtgggtcatgagttgcctggccccactaattcacacacaatgttctatttcccctggatttgtcctctgtctgtcctctctcccggtcacatgagctccttggatacagatataatgccttttacatgtcctgtctgattcaatccttctctttcaggtgggggcagtggggggacgatgaactgctcagacattatcttttttctcttatggtaaaagccagcagtgtaatgaagtttccatttgtggtcaaacagcttggtttctcaattattaagcttacatttcttatgcctcttcaccccatatttttggagaaaaacagacatttattacaaggcatctctcgaatgtgataatcatgggcaatctaaatgtctgctttccctgaattgcttcctggaatgaggtttcaatgctgcagctattctgtaatcacacaggctatttctgaagcacagggatgctttacagcactccctccaagctgagcggttggtgctgctctggtctcctggggccagcatccccaggatagatggatagcaaaggagcaaagcaaagccagctcagccctttaggatatgcacagcttcatgcaccttgggttcccttcataccctctttctttcccctgtctcctcctgttacatccttccctttttcctcctcctgctctgcatttttccctctctcatacgtccattcctttaattcagatatttttgaggcctgttctataccagctctacaccatgcagcagtggtatggcaatgaaaacagcaggccacacttggagaccttgaaatctcagttttctctctcagtccacatttgcttatttctctcattattgtcaattagtaaaatatgttttggccaaatgagcatcctcagatactgagagagacaaggttaataatttcctgtggtcatagttatcatgaaaaatgagtctaattacccacccctatcagagcttgggtcatatatataccaaaggacattcatatatcggtagttatatgcttcatactattcattacagttagttacaggattttttttaattgaagtaaaatttacatacagtaaaaaatcatggatattaaatgcacaattcaatgacttttgattggggtaatcaccaccccaatcaaaatatagacatttccacaagctcagaagtttccctcgtgcttcttccggtcaatccccacctcattaggtagctactattctgatttcttgcaatgggttacatttgtctattcttcaactttacataaatggattcacacagtagaaatagggctggcttctcttactccatcaactgttacatgtgttttcaatgctttccttaccattactaagaagtattttattgcattgtatatcacaatttgtctatccattcacctattgatgcatgtttaagatgtttccaatgtgaagctattatgaatacagttactataaacattcttgtacaagtgtttttgtgtatgtgttttcatatatctggagtaaatagctaaagagagcatgcctagatcagaaagtatgtatatatttaactttataagaattggctagttttccaaagcagctctactgttttacattcctgccagcaacatatgagagttccagtttctccacagcttcacctattcttgatgtcttgaacctttttaattttaaccaatcaaatgggtatatagtggcatttcattgtagttttaattttcatttccctgatggctaatgattttgagcatcttttaatacatttattggctatatatatatatatatatgcagcatgttttcaagtctactgattttcttattcagtcatttgtacttttattattaagttatagttgctctgtgtatatacctctcatttgtcagatatgtatagaacatattttccccaaactatggcttgtagttatattttataaatggcatattttaagtaacaaaagtttttaaattttataaaatcaaattttttcattgttctttaatagtcatccccagtaaatgttctttccacatgaagactttcacatgaatcactatttgcccatgtttgccactatttctcctatgttttatttttgaagctttataatttgaacttttacattgtggtctatgatccatcttgagttaccttttggtgttgtgtgaggtagggatcaaatcttattttttccaaatttatccatttgttccaccagcatttgttgaaaagactgttggaaaggctttcattcgttgcaaagagtttctttgttgaaaagactgtcattttcttcattgaattgctttggtgactttgtcagaaatcaaatgtctacatgagtatggatctatttctagactctcttttctgtttcattagtttatatgtatgtccttatgacaataccacactgccttttttactgctttcctctagtaaaccttcaaatcaggtagtcattcatttttgttcttctttttcaatattatgtttaattattctagatcctttgtattgctatgtaaattttggaaacaactttccagctttaatgaagtgcctattggcattctaactgtcccgttgtcttgatctattaaagaagtattaaaatgtagcctatagccatcttccagtgatagcacatccattcattcaacagaacttattgagttcccactctgtgctagccctgggaatataaagtcaaaacagcatagtgccttccttccttctgtgaacataaagtctgggaaaagaacaaggacagtctaaccaatgacacaatacaatgtgataaatggatagtactatgcaaagagtactatgtgatcaaagagtaaggacatccaaatcaaggtgataagtaaagattcccagggtgaaaccagctgagttttaaaggatcaatagggcaccaggtaaagaagaggtttgagtgtggatggacattccagggagcgagaataacatttccagcaacaacaaggcagaaaacagcttgttattaagcaaaccactatgaaaaaccaaagacatggtagatgattttcctttcctttcgaccaagtatgtgaccctggctgttgtaagtgccataaaagcccagaagaaaatcaaggatgaagagccaggcaagggaagaaatagaattgctgctaccctatttcttttttcttgtgcattttctgggatgcctgcccatggaataacctgagtacttgaccttcagctcatctcccttcctatccttacaacataacttggcaaatggcggagcaggcacaaaaacagatctctacattcccagaactgtgaccttttaaattttattttttagaacaattttttcaaacagcaattgaatccaaatacataaaagagaaaaagcagagcagctattattaaagaaaggtggtgactgcagccttgactatcaacattcaattctcacctgccccaccccacaacaccgtaactactgagtttcttttgcaaaaccctagcatgtcatgaagcacaatttgacatccaccacaccacttccacctgtgattaagtctggtcaccaccacactgtagctggggatttgtggttcacaaaacctggaaacgattttctacaggaaataattcttctccttgccaaacttaacgctaggcctttgatgttagttcgtgttacccaacatcaaaattcatttccaatggtctttgagaaaccattgtggacaaaattaggtataagactattttctaaaagagttatggaaatcctagcctttatgaggacataacttttaacaatgaaatttaacggaatatgataggtttataacagagaaaagtcatttcatcatagccatataaaatgcacacagaggagaaaagtacccttgcatatttttttaaaaagcagaaagaaatagtaactatacaaaatgtaaaggtctgcgctacaggaaattgaagaatcaagaaatgtcacatttctttatttttcagtatcaagttagaatctgctcatattccaatgaccaaaattaaacagaagtccagtacgggtcatgttttagggctatttctattctttgaattatacaggagaaataattttaaaatcatagataatattatactatagatgctggtttaatttaaaagtcttcattgattttcacagctttattgagatatagttgacaataaaatgtgcatacttaatgtacaattggataatgttgacatgtatatgtacccatgaaacgaacactaaaatcaaaataatgaatatatccattgcccccagaagtttccttattgtaatttcttccttaaaccactccctgctttgtgtaccatcccccatcactgctcagccttctgtcattatacattgatttgtgttttctagacttttacacaaatataatcatgcagtatgtactccttgtgaggcttcttttatgcttccttactgtattctgagcttcatccatgctgttttttgtttcagtagttcattcctctttattgctgagtagtagtgtttcattgtatggatgaatcactatttgcccatgtatttacttgtggatggacatttaggccattttccgtttttgcctcttacaaataaagccagaaactttagcttggaagactttagtaaaagtctttgtatagacgtaagcttttatttctcttaggtaaatacctaggagtgaggtggctgggtcataagctaaacataggtttaatttttaagaaactaccaaactgtttcctaaattggatgggcattttacattcccaccagcagcatatgagagtctaaagtgttgcatatcctcccggacacttcatatgatcagtctttttaatcttagacttttaaatagatgtccaatgttaccttgctgtggttttgatttgcatttccttaatggctgatgatactgagcatcttttgttgtgattggccacccacgtattttctttgatggaatatctgttccaatatttttctcttgttttaaggttgtgtttgttttcttactattgagtttcaagggttctttacatattctggatacaagttttttctttttaatcagataaaggatttacaaatatcttcttccactctagttttattttttcattctcttcacagggcctttcaaagagcaaaggttcttaatttttatgaagtctgatttacaaatttttttatggatcatgcttttcatattttatctaaggaaactgcctaacctaagatcacacaattttctcctttgcttccttttagaagttttataaccctaggttttatatttaggtctaaggttcattttgagttcatttttacatatggtgcaaggtatgaatcaaagctcgtatttttgcatatgaatatccaattgatgccacctcattttttgaaatgattatcctttatccataaaatttcctttgcaactttatcacaaattagttaactgtatttgtgtgagtctatttctgtgttctctattgtgtcacattgatctgtttgtatttataccaaatggtgtcatgctacttaatttgaaagtattacatgtaattgtacccaaattctatttaattttaagttttattgaattttactttaataggaaagaaattaaattgcaacagaagaaattattaaacttcaaataaatatttcttcactacaagagatatcatttcttaacaggttttcctaaggttattaaaaattataaaaaccattaaaagaataaagtaattatgtacttttaaattatactttaatgttagatggtatcaattaactgagagacccacacactaaaacattaccattttcactgttcctctcctctttctcctatcttttttcttaggatgattattgtttttatattatcaagtcttaaaattcatctgtaactgtaaatcccaaagatgcttaacttatatagagttttctcacccctgaatctgttatcacagagtctctgttcctgggttctttgtttgactcagcccctaattattttgatatcactttcaagtattaatagtttggttatgataggtaccatattccctgaagtacttcatgttcgacaatgtgtgtaaaagggggctgaatgcttgatttgatgctccacttggtcactgttgatgtagagaagagctaatgatttgtgtacattaatcttgtatccagaaactttgctgaattcttttatcagtcctaggagctttctggaggagtccttggggttttcaaggtaaacaatcatatcgtcagcaaacagtgacagtttgacttcctctttacctatttggatgtcctttatttctttctcttaacttattgctctggctaggacttccagtactatgttgaagaggagtggtgacagtgggactccttgtcttattccagttctcagaggaaatggctttcaacatttcctcattcagtattatgttggctgtgggtttgtcatagatggcttttattacattaaggtatgtcccttgtatgctgattttgctgagagttttaatgataaagcaatgttggattttgttgaatgctttttctgaatctattgagatgatcatgtgatttttgtttttaattctgtttatatggtgcatcacatttattgacttgtgtatgttaaaccatgtccacattcctgttatgaaacccacttgatcatggcggattatctttttgatatgttgttggattcagttagctagtattttgtgaaagattttagcatctgtgttcatcaaggatattggtctgtagtttccttttttggttatatcctttcctggtttttgtattagggtgatgctggcttcatagaatgaatttgggagggttccttctttctctatcttgtggaatagtgtcaaaaggattggtagcaattcttccttgaatgtctggtagaattctcctgtgaatccgtctgttcctggacatttttttgttgataagtttttaattaccatttcaatctcactgcttgttattggtctgttcaggatatctaattcttcctgacttaagctaggagggttgtatttttccaggaatttatctgtcttttctagattttatagtttatgtgcattaaggtgttcatagtagccttgaatgatcttttgtatttcagtggtgtcagttgtaatatctcctgtttcatttcttagtgaggttatttggattttctctctttttggttaattttgctaatgatctatcaattttatttatctttttaaataaccagctttttgtttcatttatcttttgtatttttgtttgtttcaattttgtttagttctgctctgatcttggttatttcttttctcctgctgggttagggttttgtttgttcttgtttctccagttccttgaggtgtaaccttagaatgtcagtttgcgctcctttggtcttttttctgtaggcctttaggtctatgaactttcctcctagcactgcctttgctgtatcccagaggctttgataagttgtgtcattattgtcattcagttcaaagaattttttaattttcatcttgattttgtttttgacccaatgctcattcaggagcaggttacttaatttccatgtatttgcatggttttgaaggtttcttttagagttgctttccagttttatttctgtgtggtctgagagatggcttgatataattccaattttcttacatttattgaagcacattttatggcttatcatatggtctatcttggagaaagttttatgcactgttgattagaatgtgtgttctgtggttgttggataaaatgttctgtatatatctgttaagtccatttgttccaaggtatagtttaaatctattgtttctttgttgactttctgtcttgatgacctgtctagtgctgtcagtggagtactgaagtcctccactactattgtcttactgtctatctcatttcttaggtctatttgttattgttttataaatttgggaacttgagtgttcagtgcacatttgtttaggattgtgatattttcctgttggacaaggccttttaccattatataatgtccctctttgtctcttttaactgctgttgctttaaagtttgttttgtctgatataagaatagctacccctgctcgcttttggtgtccatttgcatgaaatacctttttccacacctttactttaagtttatgtgagtccttatgtgttaggtgagtttcctgaaggcagcagacagttggttggtgagttcttatccattcttcagttctgtatcttttaaatatagcatttaggccatttacattcaatgttagtgttgaaatgtgaggtaccattacattcatcatgctctttgttgcctgtgtactttggtttttttgttttttgtttttgctttttaacttgtatttttgtttcataggtcctgtgtgatttatgctttaaagaagttctgttttgatgtgtttccaggatttgcttcaagatttagagctccttttagcagttcttgtagtggtggcttggtaatggtgaattatctcagcatttgtttgtctgaaaaaggctgtatctttctttcatatatgatgcttagtttcgctggatacaaaattcttggctgataattgttttgtttgaagaggctgaagatagggttccaatcccttctagattgtagggtttctgctgagaaatttgctgttcatctgataggttttcttttataggttacctgatgcttctgtctcacagctcttaagattcttttctttgtcttaactttggataacctaatgacaatgtgcctaggcaaagatctttctgcaatgaatttcctgggtgttgtttgtgcttcttgtatttggatgtctaggtctctagcaaggccggggaagtattcctcaattattaccccaaatacattttccaagctttcagaattctcttcttcctcaggaacaccgattattcttagctttggtcatttaacataatcccagacttcttggtggctttgttcatattttcttattccttttcctttgtctttttggactgggttaattcaaagaacttgtctttgagctctgaatttttttcttctacatgttcaattctattgctgagactttccagagcatttcgcattcgtaaaagtgtgtgcaaagtttcctgaatttttgcttgttttttctttaagctatctatttccttgaatatttctcccttcacttcttgtattattctttggatttccttgcattgggcttcacttttctctggtccctccctgtttggcttaataactaacctccttaattctttttcaggtaaatcagggatttcttctttgtttggatccattgctggtgaactagtgtgatttttggggggtgttgaagagccttgttttgtcatattacagttccttctcatctgggtaggctctgtcagagggaaggtctagggctgaaggctgttgttcagattattttgtcccatgggatgttcccttgatgtagtactctcccccttttcctatggatgtggcttcctgtgagccaaattgcagtgattgtctctcttctgggtctacccacccagcaagtctacccagctctggagtgacactgggcattgtctgcacagaatcctgtgatgtgagccatctctgggtccctctcagccaccggaatagcgcctattccggtggaggtggcagggggtacaatggacactgttagggttcttagctttggtgtttaatgctctatttttgtgctggttggctccctgccaggaggtggtgctttccagagagcagtagctgtggtagtatggggaggaaccagtggtgggcagggccccagaactcccaagattatatgccctttgtcttccactagcagggtaggtaggaaaggaccatcaactgggggctgggctaggcgtgtctgaggtcagactctccttgggcaggtcttgctgcagctgctgtgggggatgggggtgagatttctaggtcactggagctgtgtacctaagaggattatggctgcctctgctgagtcatgcaggttgtcagggaagttgggggaagctggcagtcacaggagtcacccagctgccatgcaaaccaaagggccagtctcactcccaccgtgcccccctcaacagccctaagtccatttccaggcagagggcaagatggccttgaaaacctgacccggtctacccacctcccagctgcaaaagaaaagggtttggttcttccacacctgtggagtctgcacaccggatttgcaccctcccccaagttttggccaggaggcttctcaccccattcaaattgctacaaagttcagctagagatttccttctccatgtggagttttatcctctgctcctctgtccacctttctgatggatctctgtggtgccaggcagggatggcctgctaggggacctagcaagctcccagggcctttctgctgcttcctctacccctgtatttccctcagctctccaagttgacccagcaccaggtgaagtcggaaacttctcccacaaacagaccttcagcttctccagtggaggtttgtgttcgggagaggagggtctccctttcccacttgcatagttgggacactcacagtatttgggggggtctctcgggtcctgcagaagcagtctgcttccttcagagagtctgtggtcctctcaggattgctggtttgttcttgcagtcgacctggatctaaaatttacagcacgagcctccacatgctgctctgtccagagctgcaatccagtcctgcctcccatccaccatgatgatccaaatccttgggttctctattttaaggacactaatcatccttatgttgtatcatctttgttttccataactatggtactattagaatctctctaaataattcatcactttggttttttattagtattttctttgatatctcaagttttcttctatgtcattaatttttatttttaataatatgtattctgtttcttgcagtttataatttattattagctctgtaatggtatgatttggtcctcaatttgttgccttggtctgtgatctcctaaaaggttgtgagaaaaatgacttatgctccttaatttcgttttcttctatgtatattttttcatgatctctccctctctctctttctgtctcttcctctgcatgcagtttcttttccctatatttatgctcaaacttgcatcattcttgtctctagacgttctatttgctgtaataaatgaaattcttctcaatctaaggttagtttgatctcacttctgaactacaatttgaggccaatgtaccacattctatctactcttcagtactctgcaagagattggagtgaggactacagtattagaagatgaacaatctttggtatcatgcttagggtctgctctttcccttaagattctcctacatctgtcactccagaacccacccccacaactggaggcatatctcagttccattgggggatacgctcagcttgtattatttcccaattgtgttccagaatctctacctcttttaaggtgcagatactttttcactcgtttctccacagcaggtgtttccaccattctgttcagaacaataaaaagatcagcttttttttttttttttttttttgagacaggatctcactctgttgcccaggctggagtgcagtggtacaatcagctcactgcaacctctgcctccccggttcaagcgattctcctgcctcagcctccagagtagcggggactacaggcatgtgccactatgcccagctagtttttgtatttttagtagagatggggtttcaccatgttggccaggctggtcttgaattcctgacctcaagcaatctatctgcctcatcctctcaaagggctgggattacatgcctggccaaaaagatcagcattttgattatatttattactttctagaatttaaaatataaattagaaatctcaggtttttgttgactagctggtaagatggttaaggttaggagctgagccatgttgcctctctgctttactccatagtcctcatgttttgttgggaccatgttttgaagtttattgcattatgctgataatgacttttaggggtttttgaaatttttttctaattttgtaggtattatgggagggcaatttagtgtagccttaatgaagttgaataatgcctcctgtacgtagtcctggacttgtattgtctacttgaccaccagtgactcaagaccaagacactttattctgccactggtcaaaccctgagatcatgagagggtgttaaaacagccaactgtggcatgaaaaatgacaaacatgtcctccaaacatatcttgttgcttatgaggggagatattattttaaccctttacatctgtcactaaaaacttacctctttcatggcctgagctccctagaaatcaatgttctaattagaaaacagtagctaatctgcccaaatgctaataaatgagggttgtgatttatctagcaacaggggaacagctcagcattaacaattaaaaggtctgtagaggacagagctttttttccttactcttccccttagctgattgagttcagccctatgctataaatagcccttgtaattaatggctatctgtttgaaaatcagttatcaggaccacagtttaggagcctttacctctgaaattcatagagcctattttatgtctcagtgataagggaatgataatgtgagttcaaagctaaacctacctacccacaaagaccaaaccacatcatagcctaccaaggcattcttcaatcttcacgataatggatacagatttttaaataatcaatccaactgcaaggagaagtactgatctttaatatagccataatgtttggctaaagcctgctgcactccagtcatttcatgactctataagctaaagtcaaaatttatatcaaaggcatgagtttgcaattagctgagcaaggtcttttagagacccccaaagagttcattttttcctacattgaacaaattaactgtgtggttcataaagttcttcttcactttaacctgactggacacagagttaaagggggaagatagcatgtctaaaccaaattgaatagtgatcttctagacaacactccccagaagggaccctccttgggaaataccactcagtgctagagtaaatctcaaatttcagtgaaggctttgtcattcacagtaaaagatgcttgcacatcttgcatgttttcttctagtattttttttatttcgttcggtattgcctacttacataatacccatgcagagctcctagaaggtcccagagcctgccatattgtttcatgacactacacatttattaaaactgtttccactatgtagatggccttttctggccagtttgcctgtcatctccctctattaggccccccagcatcaccaccaccaccctccaatctaactgataactcccttcctcaggttcccactctacctctacatttttctgtcttaataccagtaatctttacatccacttgattggtttcttgaccatctctctccaggcataaggtcttattcttactcaaatatacatttcctatatgtttgttgactatataagtgattattgaacaactacagagcatccagtctttgctaacacttggtaaaactcagaaagacggagattttttttctttgttcccaatgaattgataaaccagcggggaagacagacttctctacaactagacacagcaagtcaaaaagaggggtctaggcaggtgatgaggctgagttgttagttggtgaggcagcaaacacataaaagctcaccatgttttaatgtctcttctgtgattttcataatcaaaacacacatgcttcaatcatatgtttcacattgcttactaatgtctttgcattataactcagacctgtgcttctaaacgaatgtgcacacaaatcacccagtgatcttgttaaaatgcaaattcttattcaagagttctgggaggggcctcagattctgaattcctaacaagctcccagggaatgccaatattgctgatccatgaatgcctcaagtagcaaggctccacaccattgtaatgtcaatgtaaacattgttgaaatggcaccagtttttggaaaagctcctggactccccacctaaactcttctgactgtaattaaacatgatcaacgttacaccaagagaggtagattcagcagtgcccagaaaaaaactggcaagatgccttgaaactgttacctcttggcctttgttttactatgtaaacacaaaaggtctttgctcctgcactttaggtctgctgctacaagatgaatgtagtctgaaggtgtggcaagttttatccagatattcaagattgcctttctctgctaaagtctcttccatatttaaaccataacatcccaggttctttatggaaacagaaataccttctaagaaaactctaaaactttaatctgtttaaacaatcataagaaagaatacttaagtgaattttacaaagggaaaaagaagctctgggccaggcatggtgacttatgcctgtaattccaactctttggaaggctgaggcaggagaatcacttgagcccaggaggtcaagactagcctgggcaacatagggagaccctggctctacaaaaaaaataaatttaattagccgagcatacacctgtagtcctagctactcgggagcctgaagtgggaggatcacttgagcctaagagttcgaggctacagtgaaccatgatcgtgccactgcattccagcctgtgtgacagatcgagaccttatcttagaaagaaagagagagagagagagaaaagaaaagaaaaaagaaacaaaaacaaaaaacctctgtaagcatcccatgggaatctattttcttaactcttaatgattccaagacaacatctgttaactttttcaattcattagagtctaccactcaaaatgacaacatctgttaactttttcaagtcggtagagtctaccactcaaaatgaaagtcaaaatccattagaccactaatttctcatttgtgagttttgagttatctttccaccaagacaagttccctacttgagattttatcttttgtaggtcttcttcctctcttccccacatcattcttgagcactaacctagcccaaaccaagtgtcctatgtatgtcttcttccaatccggtaggtgtcacactcctcctatctgccgttcaactttgccttgctataatatgcgatttaacaggcaatcttggttacttggtctcctcttgcgtatttagtttttgcatcttttttttctaacaatgtaatggtaaaccgaacagaagtggaactcttttcactgggcacaacatatagaaggcaatggcagccatagcttgcgccatgcatagcctggagtagacaaacctaaatgaactttcttccttctcacttctcacggactcatttaggtgaatgccaaagatgacgaaggtgtcctcgttggatcctgggacaatatctatgcctatggcgtccccccatcggcctggactggaagcgttgacattctattggaataccggagctctgagaatccagtccggtatggccaatgctgggtttttgctggtgtctttaacacatgtaagtatccaactgagtaatttctttttaatataaaggaaacttcactctaagacattttttctataacctaacaaagagacatagcagcccctgttgacactatagaatttatgggtgagccattctgggatgtagtcaatgcataattaaattgtagtgggccaaatatgctcatagtttctctttgactgcagaatctttatagaaagaatgatagactatatcctgtgtaatccatcacttaacacccgaagaaatagagggttacagtaaaaatatagagaaaaaagccattttcttttcagccaccacattttaaaaaaactaaaacagttaaaactaaaataataaataacaaaagatatatattgcttatttatcattgagaagttgtataaatatgcgtatttatttattattgagaattttataaatatatacacttaatttttatcccagttatggaaggtattatagcaggtggtctcatattcatttttccacatttctcaatgcccctgagcaattagagatcagaacataatgaacaatctttccctctccagtttcccctctggtttttaatccacccaacatccaatctgtagaggaaagcatatgagaacagaattattctcttcagtgtcatgcatcatttttcagaggcatttgcctctctagacccagacgatattacaattaattcagtgaatatttttaaaaatacatttatttcagtatgtcttcatcactggtaatgattttcattcacaagtcatttctacagccttggagaaacattaagctcaagttggggtgtcctttctgcctgctcattaataaagaatttttacctagctaacattttttaaatcaaaaacaaagggaggggttggaggctggagggaggtcatttaaaaaaatgattacaaaacctatttgttttagctcaaagtctcaacagtctaagacttggtgatctaaatttaaaaaaaaaaagtcatgagttttgttttgttttattttcccatagtatcaaacaggataagattattttcttagccatttaaatataacccagggaagaaggaatacatatttcttgggagcaatgaaaatcaaaagtatagtcccctagaagcactggtctctgaagttccagatagaagccggaacttcatggtaggttaaaggttggaggtcatcccatccctcgaggctcccaaaccaagacaaggtaaaagatgcccaacagaggcaaccactcttgtgaaatgattttagaagacagaaaggacccaagttctccccatgcctacaatttcactatcccagtgtaattccttccggctcacaacaagataaaatagtgaacaccttacatccgttcgtgtctttggcataaaaaggttatccaatctatgcctgaaaacaggctttggcggtaaatcaagaaaaggcagaaacacacagtggggaagtcacaacgagagtaaacctgaagatggaaattgggggaaggaggaacaggtgccctaaagtcaagcctcactttcttgaaattatgagtaaggcagagtcttgaccaagtcgtgtctgggataatgtgaattagtgttcagccagaaacagaatgagagtggcaatcgttttattgataagaccctgggtgaacagggctgaaaatcaagaaaggaaaatgggaacgggaggcccgtggcagctgccactgttgtttggggcattaagatcaagtcctttaaggagggggacccttgaatctctaccagactccagtttggacttccaaggttgttctgttgaaggaggtgggtagtctttggttaaaaatgctaaactattctgaaggagaaaataaaaaggcaagccaagtcattaatcttaaaattgtcagctgaattattttcaatgagccctgatgtctggtgtcctgggaggcagggagggcatttggattaagtttaatcagtaggtacatatggcaagaaaggtattcagataatttgttatctattaaaatgaactaaaatgaatctgtggtgtcacccaccaatgcatgtcacaggagcaaattctggccaagacagcaaattccaccaaggacctactctgtaaattcctaacttcctattagtgggtttttaaaattgtattttcgggaacatagtcccattcatgggactaaaataatactacgttgatgatcaaacgcttagaaacgaaacaattagaaccctgttgggattctactctagttggcttcacctgacaccagctgcaattctgaaggatcacacagcaagatttctctctaccgcccccatggggttgaatgaccacccttttccagcatggaacatttgagaataacatgtccaaagggcttttcatgttgggtcaggaagaaagtcccctacaagaagggttttttcactctgtgtttattaaatgctggtgatgtgtttagctgtggtctgtcctttcctgtagttttacgatgccttggaataccagcaagaattgttaccaattatttctctgcccatgataatgatgccaatttgcaaatggacatcttcctggaagaagatgggaacgtgaattccaaactcaccaaggattcagtgtggtgagtttgattgacaatggcattggctgatgtcacattatagtaatgttacacatttaccacaagatagactcaatctgatgtttctgttctattttgaggaccattcaacagcacaggcagaaaactctgattgtcaaagaatgttctagcaaatgattagaaatgttactgaagagacagtttgggttcctagtgataaaaatcaatcattccttataatagcaaccaccaaaaaaaggtcatagttttagctgctgcatatgcctatactagttcctctctaccttgatatattaatattacagttaatagcagaagtattggagccaagcgttctctgggtcagtgccctgggactaatagagctaacatttatttagtatttactatgcatcggtcttggtgtatgcatgatcttatccagttctttttagttgtatcaggtggatgttattaatatcgccatttacaaatgaggaaactgaggcccaaaaaggcttgctcacggtcatacatctgttgagctgggaataaacccaaatgcttctgaccattaaccacaaccttttaaatgacttcagcagtataggttttcttttcgaatgtaaagatgagattctccttgattatattgtcacctttcattgagatatagaaatgggagtaaagctgaaattgttccccaaaaccagctgtggggttctctcactgccctgaacagctttgttacaagctggctagagggaacttaagatcccagggaaattccatttttccttgagaccccctaagtccaaatcaatacactaagaagaaacgaaaaaaatcctaagagtttaagtaggaagaatttttatcaaggtctgtgtgggaggaaattggggcataagttcctctgtggtcaggcattgagctaggtagaacttctaagccaaaaatgagtctcatgcacaaataataaagctaaaacactttctgttatacaagcatccaaatggggatggtaggaagttacaagttcattttaagcaaaactaaaagttagaagtgcctgaacttcatgttacaggaatggatcacagttgtagcagcagtattaactcaccagtaggggcacacattcattggagaatgttgaaatgaaattgctgaatgagtagcaaagtgctaccatgaattaaaaatagttcggttcattggaagggaatgagctgagccatagtaagctggagggcacgtgtaagacaaaaccttgtctctgtaaattgaacagaaatttaaagaacactttaagcctgcagaattataatatagcagccctgcatgtatatgggatgacaaaacagaccaaaatagtcaccccaaaaactcattgcaattgttaaaaatgacaaaaagatagttatttggcattctccatatctcttccttaaaaacacacagacacacacacacacacacagacagacacacagacacacacacacagcctttgtagctaagtgcagttcaaagttatctttcccagctccttgattcaggtacctcccatcatcaaataagtccctatgaggcactcctacaaataaccccacaggccctaaacagagttaatacaaaatagcgaaggtagatcttgcccttggtaaccctgtcctcattcaggtccctgctccaaattacttccccttttcctgacaccatttgttcctttggtgccttactcaaatatcccatcaccctgagactgttcttcctggcctgggaccctcacccaccctccactgcagaccactgcccgagactcctcttcccttcctttgcctggcttgtagtaggttttcaacgcatgatgcctgatcagatgctctgactgactgcggggctgagaccagcacaactcaggacgtgcccagaccatgaagcacagggattaaagggctcagtgggatctgaggccaagacttggctctgctactgcccaagctgtgtgactttgggcaaggcacaacctctctgtgcctcttttctcctctaaagtggagagaacaatattccctgcttcactcatcacagagccgagcataacaggtgcctaatgaacgttagctgctattattgccttcattattagtcacacagctggaatttcttagaggcaatatgtttccatcaacccaagtacatcaaagcggtcagaaaaagagggatgcccagtgtcctaagatgactgtgctatttctgttactttggggtatttttaaagaaaaagcagacacttggcctcaccagtgcaaacacccatgcaccttagaagttataggtggtccaggaaaacaagagtatggctaagactctcctggattgaggaggttagtgcgggctgtccccagacagatcagccagtgcatgatcaccacagccacactcctatgtcaagctctggcttgggcagctacttgctgtgtggctttgagaaaatgacttcacctctctgagcttcattttcttcatcagtagaatgaaagtaatcttagtagttaccatttcccgatggagtgactataatgattaaatcaggtcatccaggtagagtgcttaccatagaggtaggcctgatgctgatttaattattattggtcactggtaagaagcaggggctgcctgagcatagggctggtgaggaagggtgagggtgagggtgagggtggaggctaaacaggggctgaggtgggggtgggaatgatttgctgggcatcagctgacctctgtgaggtcagtgcggtgtagactggcgacacatggcctgatggatttcctagcaaggatctcaggagctattggcctcatacttacctccctccacaggctctggtcaaacacacccacctcaacctgtcttccccgctcctggttggtttgtggctggggcccctctcctctccaagtaaaggagacctgagaacaatctctcatcctccaccatctatttcttcttcaacactcaggtcccaatggtccacagtttgtgatgaatcagtttgtccagttaggtctcagtgactcagggtgtcctcttctccatgactcagccaaatcccagcctgccgaaaccagaaatcagccagcagggaggctcagaggaaaagtacaagagggtgtgagaggtgtattctgctcgccacactccagagccaggagtgacaagtttggctctgtctcttgctgtgacccttctcgccttactactgcagaccatcaaggacagactgcttcctggtttgccaccgtaggtcccctgcatgaaggatgtttccttccaagagggagcctcacctcaggggggctacagttttgcacagagcggccccactgttgacgccaacagaggccatggtctgagctccttagctgttcaggagagggctggggactcaggaacctcagaagggcagagcagggcagagtaattagatcccagggtagcaaatgaaaccccaagtgggcaaatgcaaagtagcagatcccagaaggagcaatttcggccgcctgtccccagcgtgctgatgagttctgaattatgtgtaacctctggggggaaggcagctatgaatcactggacagtttaatgaagacgcttgctcaatgtttagctgcagtccaaacagcaaatagaatacgagggctcagtgaggagggagtcagggctactcagaggggcagggggacagcaatggtttggcctcaccttggaagagctcagcttgatcacctcattatacaaaggtcacagtcaaaatggaaacaattttaaaagacagagacgttggcacttactaggatcaagaaagatttttcaatgaaaggcttcgctccttctaaatgaagaagcctccctgtgttcttttgctggagagagtgtggtctgataggatgattctgggtgagggttggtgtcctcctctcagcttttccccaccggaatgcacccacccacagggggagcagtgtctgatctattttatttttgttgttttgtcagcatgtaacagtgtgcagggcatagagcaagcactgaataaacagaattgcttggaaaaaatttttaatgcataaaaactccatgctgcaatgggtggtcttaatctataaacaaacctttttcaaagcacattttagagcagaaattaaccagctttcacacctgggacactgccctaatcagtgtataatcctaattctcattatgtcctcagtactcatatggtgtttcacacattgtaggtgcatttttgaaattgagattgttcttctatacattattttatttttatttttatttatttttattattatactttaagttttagggtacatgtgcacaacgtgcaggttagtaacatatgtatacatgtgccatgctggtgcgctgcacccactaactcgtcatccagcattaggtatatctcccagtgctatccctcccccctccccccaccccacaacaggccgcagagtgttatgttccccttcctgtgtccatatgttctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacatattcttaatccagtctatcatttgtggacatttgggttggttccaagtctttgctattgtgaatagtgccgcaataaacatatgtgtgcatgtgtctttatagcagcatgatttatagtcctttgggtatataccaagtaatgggatggctgggtcaaatggtatttctggttctagatccctgaggaatcgccacactgacttccacaatggttgaactagtttacagtgccaccaatagtgtaaaagtgttcctatttctccacatcctctccagcacctgttgtttcctgactttttaatgattgccattctaactggtgtgagatggtatctcattgtggttttgttttgcatttctctgatggccagtgatggtgagcattttttcatgtgttttttggctgcataaatgtcttcttttgagaagtgcctgttcatgtcctttgcccacttttcgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctcttgagtttcattagatcccatttgtcaattttggcttttgttgccattgcttttggtgttttagacatgaagtccttccccatgcctatgtcctgaatggtattgcctaggttttcttctagggtttttatggttttaggtctaatgtttaagtctttaatccatcttgaattgatttttgtataagctgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagagctctgttttgttccattgatctatatctctgttttggtaccagtaccatcctgttttggttactgtagccttgtagtatagtttgaagtcaggtagtgtgatgcctccagctttgttcttttggcttaggattgacttggcgatgcaggctctcttttggttccatatgaactttcaggtagttttttccaattctgtgaagaaagtcactggtagcttgatggggatggcattgaatctgtaaattaccttgggcagtatggccattttcacgatattgattcttgctacccatgcgcatggaatgttcttccatttgtttgtatcctcttttatttccttgagcagtggtttgtagttctccctgaagaggtccttcacatcccttgtaagttggattcctaggtattttattctctttttagcaattgtgaataggagttcactcatgatttggctctctgtctgttgttggtgtataagaatgtttgtgatttttgtacattgattttgtatcctgagactttgctgaagttgcttatcagcttaaggagcttttgggctgagacagtggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtctgtgccagttttcaaagggaatgcttccagttttggcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggctctgtttatatgctggattacatttattgatttccgtatattgaaccagccttgcatcccagggatgaagcccacttgatcatggtggataagctttttgatgtgctgctggatttggtttgccagtattttattgaggatttttgcatcaatgttcatcaaggatattggtctaaaattctctttttttgttgtgtctctacccggctttggtatcaggatgatgctggcctcataaaatgagttagggaggattccctctttttctattgattggaatagtttcagaaagaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttattgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtccctgagattctggtatgttgtgtctttgttcttgttggtttcaaagaacatctttatttctgccttcatttcgttatgtacccagtagtcattcaggagcaggttgttcagtttccacgtagttgagcggttttgagtgagattcttaatcctgagttctagtttgattgcactgtggtctgagacatagtttgttataatttctgttcttttacatttgctgaggagggcttttcttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgaagggtcttgactctttatccaatttgccagtctgtgtcttttaattggagcatttagtccatttacctttaaagttaatattgtcatgtgtgaatttgatcctgtcattatgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattcggggttgaaaattctttctttaagaatgttgaatattggcccccactctcttctggcttgtagagtttctgccgagagatccgctgttagtctgatgggcttccctttgagggtaacccgacctttctctctggctgcccttaacattttttccttcatttcaactttggtgaatctgacaattatgtgtcttggagttgctcgtctcgaggagtatctttgtggtgttctctgtatttcctgaatctgaacgttggcctgccttgctagattggggaaattctcctggatagtatcctgcagagtgttttccaacttggttccattctccccgtcactttcaggtacaccaatcagacgtagatttggtcttttcacatagtcccatatttcttggaggcttttctggtttctttttattcttttttctctaaacttcccttctcacttcatttcattcatttcatcttccatcgctgataccctttcttccagttgatcgcatcggctcctgaggcttctgcattcttcacttagttctcgagccttgcttttcagctccatcagctcctttaagcacttctctgtattggttattctagttatacattcttctaaatttttttcaaagttttcaacttctttgcctttggtttgaatgtcctcccgtagctcggagcaatttgattgtctgaagccttcttctctcagctcgtcaaagttattctccatccagctttgttcctttgctggtgaggaactgcattcctttggaggaggagaggcgctctgctttttagagtttccagtttttctgctctgttttttccccatctttgtggttttatctacttttggtctttgatgatggtgatgtacagatgggtttttggtgtggatgtcctttctgtttgtcagttttccttctaacagacaggaccctcagctgcagatctgttggagtacccggccgtgtgaggtgtcagtgtgcccctgctggggggtgcctcccagttaggctgcttgggggtcaggggtcagggacccacttgaggaggcagtctgccccttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggccgctttgtttacctaagcaaacctgggcaatggcgggcgcccctccgccagccttgctgctgctttgctgtttgatctcagactgctgtgctagcaatcagcgagactccgtgggcataggaccctccgagccaggtgcgggatataatctcctggtgtgccgttttttaagcccgtcagaaaagcgcagtatttgggtgggagtgacccgattttccaggtgctgtctgtcacccctttctttgactcgggaagggaactccctgaccccttgcgcttcccgagtgaggcaatgcctcaccctgctttggctcgcgcatggtgcgcgcacccactaacctgcgcccactgtctggcactccctagtgagatgaacccggtacctcagatggaaatgcagaaatcacccgtcttctgtgtcactcacgctgggagctgtagactggagctgttcctattcggccatcttggctcctccccctaattattgtcacttctatacattattttagatgctgtgtatgactcatctagttggacttttatattgtaaaattatcttcaattttaatcactgtctgcaaagcagaatgatctaaaaacgaattccaagtaaaatagtagagaagaaaaattcagaatgtagaccaaattgcttaaagatgcttaagggtttgtaaaaatatcccatgatgcattgcagttgccaattctggacagttatcagagatgcttattttcaaacattttcttgttaaccatatttctggccaagttggttttaggaaaatcacctggagttagaccatgagccttagcattagaggactgagaatatacactgaaggcacacaatagtgttggaaaaaacattatttgccaccttcaaagaataagagtagctcatgttcacaaaaatacttttttttgcaatgccctgatttaagtgctgacatgtattaatttacttctacctcttaacagcatgttaaggtaattactgttagtggcacggtaacttaaccaaggtcccagccaataagtggcagaacctgaattacaaacccaagggggctgaccccagagcccactctttttaaaatgacatccttattgactgggcgtggtggctcacacctataatcccagcactttgggaggccgatgcaggaggatcacttgagatcaggagtttgagaacagcctgaccaacacggtgataacctgtctctactaaaaatacaaaaaaattagctgggcgtggtggtgcatgcctgtaatccccgctacttgggaggctgaggcaggagaatcacttgaacctgggagacagaggttgcagtaagccaagatcatgccactgtattcctctagcctgggtgacagagtgagacttggtctcaaaaataaataaataaaaataattaacatccttattaaaatatgcttcacggcctggtgaggtggctcacacctgtaatcccagcaatttaggaggctgaggcaggtggatcacaaggtcaggagatcaagaccatcctggctaacacagtaaaaatcccgtctctactaaaaatacagaaaaattagccaggcattgcaggctaactgtggcaggtgcctgtagtcccacattgcaggctaactgtggcaggtgcctgtagtcccagctactctggaggctgaggcaggagaatggcatgaacctgggaggtggagctttcagtgagccgagatcgtgccactgcacttcagcctgggcgacagagcaagactgcctctaaaaaaaaaaaagaaatatatatatatatatatatatatcacatgctacaaaatttacaaaattcactcctttaaagtaaagtacacaattcaataatttttagtatatttttatttatgtattattattattattttgagacaggttgtctctcacccaagctggattgcaatggcaagatcatgactcactgcagccttgacctcccaggctcaagcaatcttcccatctcagcttccctagtagctgggactacaggcacacccaccacacctggctaatttttaattttttttttttgtagagacaagatctcactatgttgcccaggctgctcttgaactcctggcctcaagagattctcctgcctcagcctcccagagtgctgggattacaggcatgagccacggcactaggccatttttagtatatttgtggtcttgtataaccatcattatcatcagattccagaacattttctctcccctctgccatacctattagcagtcactccccatttctccaactctggcaacctcgaatctactttctctctctatggatttgccagttctgatcatttcctataagtggagtcatgtaatatgtgaccttttgtgtctggcttccttcacttagcgtaacgtgttcaaggttcgtccgtgttgtagcatgtatcagtacctcattccctttcattgatgaatgatatttcattgtgtggataaaccaggttttatttatccattcatcagttgtacatttgggttgtttccatttttggctttcatgaataatgttgtaatgaacattcaggtaaaagtttttatgtgaacatatgttttttatttctcatgggcatatatttagagtggaatttctgggttgtatggtaactctatgtttaatttcttttgatgaagtgccaaactgttttccaaagcagctactccattctgtattcccactagcaatacacaaaagttccaacttcatattcttgcaaataacttttattttctgttttttttttttttttaattattattgtagccatcctaatgggtgtgaagtggtatttcatggtgggattaattttcatttctctaatgaccaatgacgttgaacatctttttgtgtttttcttggccctgtgtatatcttctttggcaaaatggttattcatatttttgtcccattttaaaattgacctacttttgtattgttgaattgtaactattctttatatgttctgcatataagctctctatcatatatgtgatttgtaaatattttctaccatccatgggctctcttttcactttcttaatggtgttctttgaagcactaaagaaattaatttttataaaatccaactttttaattatttctttggatgcttatacatttggtgtcatatctaagaaaccataacttgatccaaggtcacaaagatttgctcctctgttttgttctaagtgttttacaatcatagatcttacatctaggtctgggattcattttgagttaactttttatgtatgtatgaagtataaatagaaatggagaagagagaaaaataagagagcgaataagagagaaaactaaaatcatcttattgattatctcttgtacatggtaaattatttttttaatgttgtcttaaagattctttgtttcactcaggtctgagatttgaaaaagaaaaaaagtaaaaaagagattctctatttgtcttcagcttttgacagtttgaatatgatgtgtctaagtgtagatatcttaagtttatcctacttggagtttttgaactttttcaatgtacataataatatctttcattgaatttgggaaatttttggctatcgtttcttcaaatattctttctgctacttgctctctttcctcttcttctgggactcccattaggaaaatgttaatatacttcatcaactgcataagtaacatctcacctgtttctggggctttgattttgttttagttttttgcttctgttattcaaattggataatttcaattggcctaccttcaagttcattgattcttctttctgcctgcttaactctactgttgaaactagtgaatttttcattttggttattgtacttttcagttccagaatttctatttggttccttttcataatttctatcttttcattcgtattctctatttgatgagatataattctcatggtttcccttcagttctttgaacatatttataatggctaatttaagatctttgtcttgtaagtccaatgtcttagctttcttaataccaatttctcttggctgcttcctgtgtatgggctatacttttctgatcctttctgtgtcttataatttttgttgaaaactgaacatttaaaataatataatgtggcaattcttaaaatcagatttcctgttctctagcacctattgttgatgtttgctgttgttgttgtttttgctgctgctgctcgtttatttagtgaccttcttggactaattctatgaagtctgtttttcttgtcatgtatggccactgaagtgagctgagttagcttagtggtcatataacaattggacagagatttccttaaataccttgggccaaaagctccccagctttagccaagtagcgttgtgtgtgtgttggggaaagtctttaattaacccgcaggcagtttaaaattcttcattagccttcacttcctgtgtggacagagcctcaagatcaaccagagatgagagatgaggaccttcctggggcttttcttttgggcatgctcacagccctgcacatgtttgtggctatctatgtcagagtttttcaaagcctcctatggacatcttattccctgttttttctttcaaagtgttttggatagcccttttttagtctcaagtggtattgccccttcaggcattatgatgttaaacatttgcttctattttatttttatacattatatgaatagggctgattcagaatgagctgtgaatcagatcaaataaaaacaagccctgagaatggagcttttcagagagctgccaggcaagttaagcagtggcaatttggagagaaagagctttcggagtgttcaaaactcattttctctccttcattggtttctaggctgcaagtttgcaaagctactgaggctactggtttttaagactactgtggaggtggggtgagaataaggcaaattaaaactccacaaagtcactcttcttactgagatttatgtttgtttgtttttttccttgaataaatgcccctcagattgttgtttgcttcacttccagagttctggaaaggtcagctgtgatcatatttgcaagtgttctcattgctctatggaggagcagatttccagtagtccttactctgccactctggaggtgtttcccagagcccactcttaaccactacacaagtgcttcctaccacactgctaaggtgctttacattttgtaagaatatttttggcatctagtagagtcttcctgacatatatctgctgaaacacatattattgtatgtatatccttttatttctccatttctcccatacattacggggcatgatattgatcttttagaaaattatgtatgtagaaagccatctatggatttagtttcagcctaatgaaggaatgtaaaaaatatttgcttaaaaacaagaagggggcattgctctttgaaggttggaaatcactgccctacactctcctcccgttcctctcaggtacccatccattcctgctgctggaatgtctccaaagagcgcctgaagccctcattccactcaagtctcacttgagagtaaaccaaggggagtttgggggtaaaatgtcagaggtcattgtaataacttcttgggaaattaggcagaaagggaaaaaaagtgggaatcatttaataaaccacatagaaaacactccatatggcaatggaatcatgttctggttaatcataatttttgcctacaagagtcatcatatataccgttagaaggttactagttttaaagtaattagaaactaataaagtatgcaccgcctaggctatactgaatgtaatgtaattccttttggtaattaataatacctctaggaacacgttacaaaaataagagccatcagctgtagaatatcatattcataaatagtttataatgcaaaacagtaactttggtacctactgggtctattggttggaattcttttaacccttttcaataattatggagacacttgtccagaatttattatataaacttttttatacattagacttttacaaacaaatgctctcaaaattcaatattttcttcatgttcagtcaggatattaattcctagcttgctatgccagagtggtaaaagggggtagggcttcattttcaaaatgaacccagcaaagggaacccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaaaaaaaataataaaacacgtaatcacaccatggggaaaaatgaaaggagaagaaaaaaagaaagctggataatcagcccctaattttctaaaaattgctattaacaaagctgctttacaattctcttgataaatatccaagaaatctgttcttggaagcttaagaagagagtggaaaggctgtactctcaggactaaggaaggactcactccctaaagactttgtggatggaaatttgttcagtactcctgtagtgtgtatgtgagtgaggacatctggactggtatctagccaggatgccctggtagaactgcatttagcgttgatgtcctttccgatgggttgcaacatccatttggttcatgcctgtgtctgagcacttattaatggttttgactatcactcctactacacatacacctcatagtttaatggtggaagctacagcacctgtccaagtgcaccccgccatctgcaaccccctccattgaggtctcttgtgctatatcagactgtatttacacgtgacttctcagtgagacttgcaaaaccccttgccttcacaggacaagtaagaataaacacattcatttcttcttttttcttggcggtcagttgattcctacaacagcatcctttactgagctgggatgcccatggcgccctccatttatctcccatatagcattgctatgcaaatgaggccattcatgactggctacccagggcttccccaggtggctcccagccagagggatctgaagcagctgagcctcagagaggacaggggccctggcctagtctccacctgactggactgctggcctttgacatgacgccagttaacatccaaatgccccttgctggtttcagcactccaacaggctcaaacaatgaatagctgtattctgaaatagtgtcatgctcgcagctccatcaaagattcctgcagcatgcctctttcctctgaataattcctttctgtcatcttccttcattatatttcctaacaagtttttttctaagtccaggctttcatttccactttgaaatgtcttgttagacaagcctcagagtccaccaaattgttcccacttctttccaacaactcccaccccatcctatccccactgcccctgaaatggccagagcttaataatccaggatgtcctgtcattattgtcaacaatattgttgtctgtattcggaatgtattagcagaaccagagaggtagggctacacccatctgctacaaatacacaaatgatttgcaagatagacagtgcctttctttcaccccctgccagttttgctatgaaagaattcaaacccttggtttacagttgaagttggtccaagacatctcctccagggctttctcttgatcttatttgtgctctcccctgagccctaataaagctgcacaaacaaaattacaagcccatatctctttcttcccttttaagaactccttttctctgaaacatttctggacagatagattgtaaatgagatgaccctgtggactgtttaagcagttagttagccaagttaaggtcagtaaaggactccttgtttaaattaaccactttattttcttcaaacacatagcaccctgaagcccatgttggtctcagctgtgttctctgtccagctcttcaccaccccataggctcctatacctctggatatgaccttagccagaaccaagacagattttgaactactgtgctctactgggttttggtaaaataaatacataaataaataaatagtcctcagtgtttcggagggaacctaatacatgtttattatgcagtattttaaatgttgcagaaaaaataccaaagtaagaagtatctattttctaactactcagaacatctgtaacatttccttaacccttctgtaatatgtctctttgtgtgtcgtatgcatgtttttaatgctgcataccaaagtaccaaagtaccacaacgtaacagcttaaaaaaacacaacttatcatcagacaattcctgtgggtcaggagtttggtcactggttgactgggtctctctgctcagggtctcagataactgcaatcgatcagtgttggctgggactgttgtcccatctaatgctcagagtcctcttccaaattcattgaggttcttgaaagaattcagttccttgcagctgtagaactcatagatgcttctatcttctttgaagccagcaggagaatgtctctgctgctttgaatccctgacttgctctgtctctgatctctagacccagacttaaaaggctcatctgatgaggccagacccacctgataatctaccttttaattaactcaaagtcaacagattagtaaacttaattacttctgcaaaatcctccttgacacataaagcaacatagtcacaggagtactagcctgttctgtttatagatttcacctacactcaggggagaaaattatacaaaattatgcaaaaggtagtgggagtcatttaaaattctgctctgcatgtgattttgaaacactaatatgccatggatgtctttcttgcctagtcaatatagatctgcatttttatggctgaatagcattctattctgtttcaaaatacttgatcacatgttggacagttaggctgcttccatgcttccactttccctttcttacaccatgatgaacattcttacataacacacttgtctttgcatttgtatgattatttcccgtgtacaaattcaaagcacatggatttactgaatcacaacataaactatgacgtcccatgtagggtcccccagcaggggatggtgctgctgttctagtgaagtactgcctttggtgaaggttctctgagtcctttgtaccaatactgctgaattattagcatccttgaaaggagttctaaaaattactagctgtcactgcacggaacacacaggaagaaacataaagcagagatgtgttcttcacttgtcatctccatcgttatcctcccaaaggttgttctcatcttgattaaacaagtctcaatgaaatgaggcctttattttgatttctatactgcttctatagaaagaggcaacaaggagatttagaatttttttactttaaagggacacggtaccttttgactgtatagtgagaacttaagtttcaaatgaaggctccgagaacataaaaaaccatgaatcttaaagagaaacaaacaagcaaaggtttaataagaacttccttgctagatgtcctcatgatttatttagccaacacttactgagcacctcctaatgactgggccctgctctagtgctggagatgtgtagaagaataagaccaacagagctcccaaagtagatttatgcactctacaaatgcatgatggaattgcaagatgaaaacagaaaaactcttatggatctagataaagaagctttagaataaaaagtagcatttcaggaatcagttggtattttccaacctggagaatcagtagatgaaattaggaaaagtctgtacggaaggaataagtgtttgagatcaaatatacaacatgttggctatagttaattatactatactatatatttcaaaattgccaggagagtaaatttcaaatgtttgcaccacaaaaataaatatgggaggtaatcgatatgttattaacttaattatcctgcaatgtgatttgattttatatatatatgtaaaatcatcactttgtaccctataatatatacaattatacaattattatgtgtctatttaaaaaattaaagatatgctaaaggaagttttccaacacaaagggaaatgacactactgtatattgaaaattagatcctctgacacgtatgaattgcagcaaaaatgctaaatatctgagaaaaatgctcacgcctgtaatcccagcactttaaaagactggggcaggaggatggcttgaggccaggagttcaataccagcctgggcaacatgagaccctgtctcaagaaaacaaaacaaaacaaaacaaaaaacaggaaaataaatgtctgtaaacattagcctctttcatggaggaacttgggatataaaaaactgagcatgcttaaatagaattgtgtaatgtcagccaaatggaaactcttgaggcacgggtggcttaggacacaattcccctagtcattcctgagtagagaggattgcatggtgaaagagatccccatggctgtggaggtagcaccctctcgttctcttcatgggctgtctgggagctgagccattagctttccacccattgatggaggcccagccctactgggagcatttgcttcctccccacctcacccactgcctgcaagttcctgaccctgttatgaaactcccaccctaaatacacagataacgtctcagccatgagtgaaactagaagagatcatgtgtaactaattagatgtcagagtgagagaaaagaaacttttccccgggtcctggtcatttgaaaagaaatattatcctcaaagaaaagtctttacttgagatctgaagtgcaaagcatatttatcttgttccaggctaaccttgccaaggatatttgaatttaaataaggctattctggagcctattaatctagggtgatggtgtagcagtgaaagccagggggtcactaaacacttcgggtcgtataggaagcaggacggcgtccattcagggttgcaaatgttttattgctgtttttccctgggtccttctgcctgatggggcaaccttcactgctctggagagaggctagcagagtcattgtctaacatacacagtgacctcccttccagcttccaagcaaagatggaggctctcaggtgggaactgacctcatgttcctgctcagagacctccacaccttcaccctaatccacatctgtacccttctctccctgcagaccctgccttgcttcccacatctgtccagggtgttgctctcagcctcatcctcttgcaaccttggtatttcagctcccttttatattcccactgtctctaccttcctccattcctccatgaacatgcctcagtctcttttaatttgaaaataaccgaaacagacttccctgcattgcattacatgctagcccctgccctatcttttcttctgtcttacaacctagatcacttttttttttttttttttagacagggtctcactctgtcttccaggatggagtgcagtggtgcaatcatggctcactgcagccttgatctcccgggctcaagtgatcctcccactcagcccctcaagtagctgagactacaggtcagctaacttctttaactttaatagagacagggtttcgccatgttgcccaggatggcctcaaactcctgggctcaagcagttctcctgcctcggcctcctaaaatgctgggattactggtgtgagccactgtagccagcctctaagtcactcttaaggaagaagctacctctttcttccctcctcattcatttgtcagctggctttgcccagccctcctccaccacccaccaatactcccgcaacctcctcctccgcttcatccaatccagagcatcacaagtgtagacaaaaatgcctcttaggcctcacctcctgggtttcccacaggcactcaagctcatcctgcccagaattgggctggtcatccacccatcaccaccagtcccaacacagactttcttctcttccttttttattcacagtcttggtaaacaaaaccatcatactacttggacaggcaaaagtcttccccaactcatccgagtccctcacatctccctaaacctgtgggttgtatccccaatggcttctctccctctccatggtgctggccacctgaatgcctttctggtccactattgcagttcttcaggggtgggggacagccggggaggactcagctcaatctccagccttgcctctccatccatcttccacgaacagagatttgcaaatttagatcttcttcttaaattattccaatggctttttatagcctaagaataaagcatgaatgtttaatttgatatcaaaggatttcacaatcttatccttacctatatcataggtcagtgttgaagagtgtggatttcagagctctatcactaactagctgtgacctcagcaaggttcttaaccttcctgggtttcagcttcctcccctgtaaactgggggtaattataatagtactgttctttttttttttttctgagatggagtctcgctctgtcgaccaggctggagtgcggtggggtgatctcagctcactactgcaagctccgcctcccgggttcacgccattctcctgcctcagcctcccgagtagctgggactacaggtgcccgccaccacgcccagctaatttttttgtatttttagtagagacggggtttcaccgtgttaaccaggatggtctcgatctcctgacctcgtgatctgcccgcctcggcctcccaaagtgctgggattacaggcgtgagccactgcgcccgaccaatagtactgttcttatagggtgctagggacatcagatgtgttaacatccatgagggttttagaacaccacttcgcactaaggaagtgttatatgtatttgttagtttcgtgcattgcctgccatcaccgttctcctatgaacctgaatgttcaaacacgctatgctccagccacaacacacagcagacagttccacaaacaaaccatgatggctatttcatgccgctgtaactttgttcttcctccttttcttgacctcctaaattcccatttatctttcgagcctcagctcaaacatcacttcccaaatacctggagactttgctccactgagactccatggcaccccaaatcaacacccgttttaccagggatcatttaaattaattatttttcaaagcctgagagttaccatttttgagcacttaacacatgccagtctgtgttcgaaatacatgtattagcttatttaagtctcacagcaaacctatgacagttttgataattggtttacaggtttgtcatttctcctagaagattaccctttatgggtaagaatctatgttttgatcatctctgagtctccagcacctaccaaggtgcctggtgtgtagtgggtacatagtgaaattaatatctcttgaaccaatcaaaaatgggctgcactcagagaaagatgggagcatgggcaaacagctgacattgaagggcgtctaggcacggaacccgtggtagttgaacctgaaattcatcagtgtcataaacaaagactgctgtaactacctcaccacattattaaatctttctttattactatatgaacattttctatagtgctgaggggttaatgtgctctcatttgattctgtactgtcatataatttcaggtcttttcaaggacataataatacaattcatgatggcattttattccatgctcttgcttccagggtcatattcaaatttctgagaagttttccatgacccttagcacttttaataaagggtaaagagagattcaccctgacaacgtattcttcttgttggacacgagatggaaattgtagagaattatagtcaggcataattgttgtagtttctacagtaatagtctaagaccacaaacacaagtattttttgcttaattgctacaaaggaatatgctttttctaaataggaactatattaaaaagttcaaaataaatatttcagttttggttaacttttcttccccaccctgtcggtacctagtaagttgtttcgttagtcagcagaaaatggttaagattaaaactgttcaatgcactgattcaaatatctttgggtggccttgaagctgctcttagcagagggaaagagacatccagccatgtgagtgtcctgagggatgccaatgagaatgaatctgcccagaaaacccaagtctagagccccaggatatctccaggagccctcagatttggcttaatccattctaataatctgtagatagcatatgcacaggatttggggtcacttttttttttttttgagatggagtctccctctgtcaccaggctgaagtgcagtggcacaatctcagctcactgtaacctccatatcccagattcaagcgattctcctgcctcagcctcccaagtagctggaactacaggcacccgccaccacacccagctaatttttgtatttttagtagagacagggtttcatcatgttggcaaggctggtcttgatgtcttgaccttgtgactcacctgccttggcctcccaaattgctgggattacaggcatgagccactgtgcctggccgtcacttcttgatctcttggagcattgggtgtgatgggaagtttaacctttctgggcttgtgttttctaaggaactaccactgctggaatgaagcatggatgacaaggcctgaccttcctgttggatttggaggctggcaagctgtggacagcaccccccaggaaaatagcgatggtaaaactgtgtcctccctctgggaacttgcttcattgctgatctttgttttgcttttatgcttgcatttgatgtgtgggaaccacgcccattgggaggcaacatctgaagtgtgcttcctgggcacatgtacagtattagctaccttccaatcaggtttaatttcatttccattgtcagctttaccctgattattttacagattttagagaaagaatataaaacaacgtataattcatccattcttgctttgctaagcagttttgaagacaggagagaaaatatctgtaagcatttttactaggctataaaatatacttcagccctttgtggtatgcactggtaagatataaggcaggagagaaaatagagaactcgaaaaataattatagatcatcctttaaattgtttttccagaacctggcctccttttatgtcatgtgatttcctccaaagcttcagtatgtgggtatttgtcttctaacttgccaactatgctaagcagctgcagctctgacctcccccagatttttataaaatcacatcataagcctccatctctctttaatatgataatataaagaatcagtagactgtggatattatgtttatttcctcaggtgttgatatatcgatgggcacacacaggaacatgcataaacattcaatggatattcatactgaaaccatattataatcctaggctttaaggaagaaagtttagcactttctggtgttctggtatatatatcatggggacattttacaggtgactaatagcagctaatctcttattaactatatagataggtggttaaaatttaaagcattttagaagagtaacataggccctctgacttcctaaatgcatggtgggcatggccaaaatgcacaggcaatgtccaaattctccagttaaacttgacatatgttcataatgtccaaaaacaaaagacaaaaagcaaaacaaacagcaacagcagcacaaccacagagcacacatcaacatttccaacatttcagataccacctgaacaagagataaatgctgtgtaagccacctgcttggcatcaacacatctgggtatgtgtctgtaggtggcagagtagatgcaggaatagtgttgccttgtatttatttccatggcttcaatttttggcttgagggggcatagccaatggaattctcttcagccttggaaagcatctgggctaaatcagcaatgaagttgggaacactggtctttacagagtcaccctcagtgccatgaatcttgcagtatctggacagaattggagatgacaaactcacaccgcccttcctctgtgcaatgcaggcatgtatcggtgtggccccgcctcggttcaagccatcaagcacggccatgtctgcttccaatttgatgcaccttttgtttttgcagaggtaagcaggaagctggaggaaagtgctgtttttctccccaacctcttaacacatgaaagagtaagctaaaagttgttgtttctaagttttccaggtacatagcgtatgcttcgtgttgacaaaggtaactaggcattattccaacttccaggctattaatgctaaatgcagttcttgtttaacatttttctttccttgatgttttgggattccctactcccaaaagtaaatgctttactaacattagcttagttctctgcacccattaagtatcaactgctccagagaaattatatgactaatggatctctcaactaacctcattggaagagatgggtcatgaattgaaatttcaggacatgccacttccctctgggactagtccagcaatccaggtaagacaaaatccacatacacacacccaaccatggtcttaccctggcctttgcaatctatgtcctgccatcccacaccatcacctgtggccagggagggagggttgagttgccaaaggaggaaggggagcctggaggctactctaagagaggaatacagcccacctacagggttgatgggaatgcctgggcaaaggctctgccatttcagaagaactaggcagggactggaagcagaacaggctgttaaaggatactcaaggagagctctgaaaatcaaattaaatgtaagagatgttgggtaaacgagaaggctgggctgccggcctaggaagacttgaaagactgagaggcaggacttccccagggtatatttgcaccagtaaatacactgaaataatgtctttcactttgcctaccattggatgctcttagcaaccttctaaaattgataattcttcccattttacagaaaataaaatcgaggcaaagagtgattaagtgactttctcacaaccatctagctaataaatagcagtgctaagatttgaagccaggcagatacctgaatgcatactggtaaccattgcactctagtactccaggaggaacaaatagttattattaatgtacaccaggcattgtactggggggaattctaaggttcaagtctttaagaaacgtatttctagatgccaggtgacagggcacaaacacactgaacatgaaataacaacaatacttgtcaggtgggccatgtagagagcacagatctgcattcatatgatgcatgagttgggaagtagaggccaagaactgaagcaggatggcaaagaccacaagacaccatctaggaaggaagggcgacctgggaacagacagtgaggatgcctgtggaagtgtccccaggtagtaagagcagagaactgtgggaccacatgggaaggagggatgattaggcaaaatgattagaaagaagccagaggaagggaggagtgcaaagcagggggatgagttgagcatctgaaagctttgtgggggcagttgaaagctgtgcagactcactagaacgccaaggatgcatcaggggtgttggaaggtggaggctgaaggaacgcagtgcagaggacctccctgagagacttgctccttgtccctcctgtaagtgagggagagttttcactgggtgggaacttgggcaaggtgctgacagccttgtggaacacggattggaggggttgttatgaagttgtggggaacatctagagggctggtcatccctccaagccagagatggaaagggcatgagctagacaaatggcaataatgaggaaaagaggaggcaggactgagaaatgttaatatttagaaagcaaaacgaacatcaaaattcagacagcaagatcaggaatttgaaacacacaaaagaccagtgttcatctcatcgtacctgccgtggcagtttacagaagcctttggagaccaagcttactggacttggaattttatcccctcgttttcactttgggatttgaagatttccacaaacctcccagctgtcatttgatagtttatgatgctacgagagcccctaatgaggagatcactctgaaatccacaaagccttgttttcagctttttattacactttattgctgcaaagaaggagaaggaggacctccctccacaagcaagctgcctaatagctgtaaatgcaaacactttttgctattattaaatatagatcggggtgttatgaatgtcatcaggatttgcagattataattactcctttctcacccactgcagaggcgtgtctgacagagggtacaatttgttgctttggcatgggctgcgctccaggggctgagccatttttaagagatgtttgagttgatgaaaagtgtatgaggaatcttttctcaagggtgcctgcagtgggaccccatggggagtgtcatatgagtcgatatgactcaggttcgagtctgtggctctctctgctctccctcgtccttgctgcatcagctcgccttctcttccctcccagcatgctgactttcttggtcattccttactcatttccaggcttgatcaagcatcatgttcattgactgttttttagtgttcccagggccttagtctccatgagtgaaagcagagcctaaaaagaagaggggtatgcctggaaaatgtcttaccttctgttccttttttctctcctcctccactttggaagttcaccctccacatttctgggtttctgccagggcttgaagcttatttctcttacccctcccttcccatgtcctccctgctgcagtgggttcctgtggatctgaagccccatctgcctatctccccagcttatggtggcctagggcttccaaataggtgagaggagatgagagctgttctaagcgtctggagtcgtattccaagattccatgttcacgaagccctcaggggttcttagtgaagaactctctccttcttgccaaagataactctcttctgtcctaacttctcattaactctgctgccctctttcacaccactccaccccaaactcactcacatacacacacacatgcatgcacacactcctgcctgccctcactggcgctgagatgattttgacaggagcaataactggctccctgggaccacagcaaccatctcatcactcaagaagctaagccctcctctgctgtgggccagcagttctcttatacaacgtgtggagatgttttcctgtagattattcattctcaattcaaacttatttattttgctactatcttatcagatgcagcctatttttttggcatctcctacttggctataaaataatccagtcatttattcaaatagcatacaaaactttggaattattttagctttccttcttaacctcccttatgcatcttgccaaaaataccttcccaaaattatcataaatccagccacttctacaatctctatcgttaccctctgagctctgtacaacactgagctccataaagttacctcctaactcctcctaactcatctccctgatccccctcttgctccttttctgtctattccccacagagcaagagaattattctttaaatgtaaatacaaacatcacactcctgccccaacccttctggtggagttccaccacccttacaataaaactgaacataaattcctacaagattccatggcttcccttccacttcatcccttgtttatttccctccagccatactgagatttttctcttcagaaagcatccacacatcctcttgtgtcagcacttttagacatactgctccttttgctaggaaagctcccctcactatctttcactctgtgtaggaagaatgctttgcatgctttgttccctctctgcattcaagtctctgctctggtcacctcttcaaagaggccttcgctcacccaactgcacctaaaatatcaccatctgccctgttgttttcatcctccaaccttagtgtgtactccatttctcccttctagaatatgagctccatgaaggtagaagctcttgtaaccgcattgctgagagcaggatctagggtccagtgccaggaaggcattcactgcctccatatgccctctgagaagcagcattttctctgcagagcctgcagacaaggttatctccacttggaaacaaataaacaaaccaaagcaaactctgtccagggtcctgaaagcaagagcacgtctctagcctcagtggtgaagagcatatcttctgccacctgtggacaaatgttcacattctatgggcccaggtggacatttgcagagagcagcccccaagcctgctttccaccccacctttactgagaagctagggccctgaccaatggtagaggctactatgtaggaagtgcctgtacttaagaggcaagggtgtggtgttgtgaaaaaaatatccaatttcatgcaccaatgcccagattttgtgtgatgataacccttcaagtgtagggatagaaaaaggggatcactaacattacattcaaaagaaggaagaaaaattagccgtaaatgtagggctttcacaagtagtaccaatctatccaccagcccgacaaggaaggtaggctcagagagattcagtaactcggagggaggagccaagatggctgaataggaacagctccagtctacagctcccagcatgagtgacgcagaagactggtgatttctgcatttccatctgaggtaccgggttcatctcactagggagtgccagacagtgggcacaggtcagtgggtgcacgcaccgtgcgcgagccaaagcagggtgaggcattgcctcactcgggaagcacaaggggtcagggagttccctttcctagtcaaagaaaggggtgacggatggcacctggaaaatcgggtcactcacacccaaatactgcgcttttccgacgggcttaaaaaacggcgcaccacgagattatatcccgcacctggctcggagggtcctacgcccacggagtctcgctgattgctagcacagcagtctgagatcaaactgcaaggcggcagcgaggctgggggaggggcgcccaccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcactggttctcccagcatgcagctggagatctgagaaggggcagactgcctcctcaagtgggtccctgacccctgacccccgagcagcctaactgggaggcaccccccagcaggggaacactgacaccttacacagcagggtattccaacagacctgcagctgagggtcctgtctgttagaaggaaaactaacaaacagaaaggacatccacaccaaaaacccatctgtacatcaccatcatcaaagaccaaaagtagataaaaccacaaggatggggaaaaaacagagcagaaaaactggaaactctagaaagaagagcgcctctcctcctccaaaggaacgcagttcctcaccagcaaaggaacaaagctggacggagaacgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaagcaaggctcaagacctacgtgaagaatgcagaagcctcaggagccgatgcgatcaactggaagaaagggtatcagcgatggaaaatgaaatgaaagaaatgaagcaagatgggaagtttagagaaaaaagaataaaaagaaaccagaaaagcctccaagaaatatgggactatgtgaaaagaccaaatctacgtctcactggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttaccctgaaagggaagcccatcagactaacagcggatctctcggcagaaactctacaagccagaagagagtgggggccaatattcaacattcttaaagaaaagaattttcaacccagaatttcatattcagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaataaccagctaacatcataatgacaggatcaaattcacacatgacaatattaactttaaaggtaaatggactaaatgctccaattaaaagacacagactggcaaattggataaagagtcaagacccttcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagttcttagagacctacaaagagacttagattcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacacaaattataacaaactatctctcagaccacagtgcaatcaaactagaactcaggattaagaatctcactcaaaaccgctcaactacgtggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaatacagacacaaaaaacccttcaaaaaattagtgaatccaggagctggttttttgaaagaatcaacaaaactgatagaccgcaagcaagaccaataaagaaaaaaagagagaagaatcaaatagacacaataaaaaatgataaaggggatatcaccaccgatcccacagaaatacaaagtaccatcagagagtactacaaacacctctatgcaaataaactagaaaatatagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaacaaaaaaaagagaattttagaccaatatccttgatgaacattgatgcaaaaatcctcaataaaatactggcaaaccaaatccagcagcacatcaaaaagcttattcaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaaattctggccagggcaattaggcagaaggaaataaagggtattcaattaggaaaagaggaagtgaaattgtccctgtttgcagatgacatgattgtatatctagaaaaccccattgtctcagcccaaaagctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaatattccatgctcatgggtaggaagaatcaatatcgtgaaaatggccatactgcccaaggtaatttacagattcaatgccatccccatcaagctaccagtgactttcttcacagaattggaaaaaactactttaaagttcatatggaagcaaaaaaagagcctgcatcaccaagtcaatcctaagccaaaagaacaaagctggaggcatcacactacctgacttcaaactatactacaaggctacggtcaccaaaacagcatggtactggtaccaaaatagagatatagatcaatggaacagaacagagtcctcagaaataatgccgcatatctacaactatctgatctttgacaaacctgacaaaaacaagcaatggggaaaggattccctatttaataaatggtgctgggaaaactggctagccataggtggaaagctgaaactggatcccttccttacaccttatacaaaaatcaattcaagatggattaaagacttaaacgttagaccttataccataaaaaccctagaagaaaacctaggcattaccattcaggacataggcatgggcaaggacttcatgtctaaaacaccaaaagcaatggcaacaaaagccaaaattgacaaatgggatctaatgaaactcaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttgatgagactgtaaactagttcaaccattgtggaagtcagtgtggtgattcctcagggatctagaactggaaataccatttgaaccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactacgcagccataaaaaatgatgagttcatgtcctttgtagggacatggatgaaattggaaatcatcattctcagtaaactatctcaagaaccaaaaaccaaacaccgcatattctcactcataggtgggaattgaacaatgagatcacatcatcattctcagtaaactatctcaagaaccaaaaaccaaacaccgcatattctcactcataggtgggaattgaacaatgagatcacatggacacaggaaggggaatatcatcacactttggggactgttgtggggtggggggaggggggagggatagcatagggagatatacctaatgctagatgacgagttagtgggtgcagcgcaccagcatggcacatgtatacatatgtaactaacctgcacaatgtgcacatgtaccctagaacttaaagtataataaaaaaaaaaaaagagagagattcagtaactcatccagagccacacagcctaagtccaataatccttgccatacactctgaacttatctattgttctaccatagagcgtcaattgattttgggtggggccaatcattccatgcttttttaagctcctagatgattccctagtacaaccagaatagagaaccattccactacaggccgaaaccaaaaagaaagcttgctaatgtcgcttggaaagaataatttccctccacatcccaccccaacacacatatacaaaagccaccccatacaggtgtttctcgtctcctctctccgcaaaggacagtgctgttggtctgtcctgagatttcagcctacaggaatttctgaagccatattcaaggtgggggggcaggaatcagccactttcatattttgcttgtttccctggaaaaccacaagctgttataaggattgttattaagaagttatttatcattattgttgctacgatttgaaagtagagggggtcgctgtttgtacttacatggcttcctccagagggaattcccgaattctcagacagctcatttaaagcttccaaaatgacaaatattccacaggtatctgctgcgtcctctcctgtcctgattcctgacttcacatttcagcctttcacaacatgtggctagcacccctgagttctggctgctctgctgaggggcagggccaccgtttatcaccctcagaaatctgagccgcaagtgtggaaccatctcaccactcaagctggggctcatgctcccgcagggtggtgtgggaaaggcggtgtgccgtgaaggccaagggccaggttatgggctgtcccagggcttgagctgcttctccagcagctcctagccatgaaaccacaaacactttgcctcccccttctgagtcttggtgccctcatccataatacggttacaatatatacctcacaggcttgttgttgtgaggttcaaactaaatcctttataaaatgtccctgaaacattgtaggtatgcaacaaatgttggctatctcccccttagtagaaatccgacttcatgtgcactcagaacattctgtgagaaagtaaaattgctctctttaacctcaactttaaaacctagggatatatcttcaagtttccccattacctaatgatgactattatatttttactcaattttgaaatttacaagtcatgttcacatagatcttatctcactctggcctaaaatgctcccataaaattggcagaacaaatttaatcatttttattttatagaatcaggaactgaagttcatagagattaacatgcactttctacaaggacacacccactatcggaacccaggtttcttgcagcaaatctagtattcctctcaaatgccatctaggtttcaccttggctgttactttctagccaacccttgactccactgccccatgtgctcccaaagtatcttgtacttattctttcatggtacttatcgcactgtattgcagggcttctcaagcctgactatctaacagaattatgtgagactttttgtaaaatataatggatttagggcctcacgtgatttaggtcccacctccttaatcaggcgtctatttttgtttaaagttctccaggtgactctgatgcacagaatcatgcttactaaagcataaactctctaatggcagcaaccaaatctattttgttcatcattaggattctgaatccttaaacaatatctggcaatactattcaatattattatcaataacatttactgagcatttactctatgccagacactatgataagtaatgtgtgtgcatttgtttctgttaattctgccaatcgtcctatgaagaaggagttattatcaccctatttaaagagtgggtaactgaggcttggagaggagcttgggaaacatttagtaaatacatcaatgactattagcagtacaattcatgcttcctacctgcttccatgataataactggaaccttcaagaaagtgattataaaatatgtaataaaggactctggtacagtcagctttcaggcacacattagtcattgtctctagaaagtagaatagtaaagcagagccttgggagagcttgggggcagacagcatggccccaagacactatttctgagtcccacaaatagcacattttagttgctgaaccaatagaaaatagcctgaattcctcctagatcatctaatattattgttcaatttaaatacttttggcttcaagtagcagaactaatgtggctgaaacagatggggactgattttctcatataagaaatcctgaaataggtggtcctgatgcgggcttagccatttaacagcatcattaaggcccccaaatccccaaacgcctctcagctttctactctgccaccttctcattgtcagcagtgtttctgttcactgtctcacgatggccacagcagcttcaagcatcccttcacctgaaaacacctgaaaacagctgaaagcagaaggggaaggacaaactcatccatgtacctctctcctttttcaaaggggaaaaatgtttcccagaagccacctagcagacttcctcttcctcctggcagtaggtcacatagccacagttagcccaaaagaagtccagggaagcaagcgatgggcatggtggcatggcattgtcttctctcctgtgagaggtaggacttatcacaaggacagaggagggagaaaaatggttgcttcttagacagtttattatctcagcctcaaataatctttatttaaagtactactaaatcaactagattcgcctttagaatattttcaaaacctgtttggccctatgatacgaatccaatgttgttgaagaaaggggcatgtcagctccagagatctctagacgactgctctatggacagttaaagactttggcaacagcagacatgtgatgatggctaatgctctcctctcctgtttccaggtcaacagcgacctcatttacattacagctaagaaagatggcactcatgtggtggaaaatgtggatgccacccacattgggaaattaattgtgaccaaacaaattggaggagatggcatgatggatattactgatacttacaaattccaagaaggtaatttactaccactgaatgaagatttatttgcccaagtccattgagtacttattcattgtcactcagagatgagttccagagaatgcactggcatttgcagcatttggtagcaacagcagaagtataaactttcacgtgtgaaagacacgtcacatatgcaatttttcattgtagttttctttgctagcttgctttgggcagaattctcattcacgtggcttgtaaaatgatttggtttaaagtcatacctaatttaacagaatatagaatatgttcttgctcacaagaaccttaattttaaataatcctattagaaaacactgtataactaatgtaattttagtccaataatagaaattaaaataactacttcacatttgtttagtactttaccaattatttccacatacattgttctattacattatcatggaagactacaacgtagataatacaatattaataggacaatgcaatctctctaactcaggacaattaggtcgaaggccagtttcaattccaaaataatgtcatggtgggtttttgttaacttttattgcatagaatgtttcaaatggcactactgagtttaattctatctcaatcaatgcttagtgtccgctctatgcctgcaattggtttggtgctggcgattccagcagtgagcaggactcagttcctgtcctggtccgagtgacaggattattgtgcagaggggtctttggaaacaataagtaggggcatttagtccaactgattcagaaaaagacttgagaagagaagtcgtggacctcggttaaagaagctggacaggggtttccagacagtgtgaacatgaccaaagttacagggcgtgcagcagcccggtatgtttagggggatcctgcaggctcagaatgcccagtgactgaagacaaagctgcccgaggccagcagtggccagaactggaggaccgtgagtgtcctgatggggaacatgcaacatattttgcaaatgattcactgccagaggttcttaggagtatttatttttagtaaatggataaaaatgacaagtaattagcatatacctaaatattcattggaatccatgaagtgctaaggagtgcagaatttattttaaatagtttagacagtctccctgctcttatttacaaaagtaatttgcactacaaagaagaagcttgctgaattgagaacacttgtgcatagtctcagaaagtcagaatttttgttatctgaactagtgaattttcactgtattttttaaatgcttcattttcctcttctgttggttatcatccattgcacaacacagatacaaaggtggtatttttttgtcatttggatttttccttaaaggaaaatttaaaacaatataagtgcaaataaaacaaaacaaacaagcaatgccctcttactgtagagttataagcaaaaaaaggtttggagaaacaaaaaagcaagttcatagaaaagttagctgcaacatccactcattcatacatacatccacacgacagctggctcttaccatctgccatcttccagtgctgtgtagagctggatacatgtacagccctgccttcccatgcagctggggagaaaagcagaaggcagccctcactgtgctgggtgagaattgctctggcacagggtggacgggtgctgccgggcacagagaaaggctctcagccaagaatcggcagttggggaagacctcgtggaggaagttagtgatgggctcactaagcccaaaggacacacaagaattggcagatgaagctggggaaagaggtccccaagaaaaggcagtaaggcaaggactgtggtgagaactctcgtatttggaagaagtcctgaccagacagagtagtgaagaaaagttgcacctacaggcagctaggggcagcaggaagcgagctgtccacatgacagatgtctcttggaaaccatggagccgagcacagctgccattagctgtcagcatggaggtgacagtgaaggccaactcaggaatgggacagaatcagatgccacgagaggaaagactaaaacccagtccacgaaacaggagtcaggggcttggctgggggtggataacaaattaaaacaaaatgtgtccgcactgcatgaggaagacatctgaggtccaggcctctagagtttagcaaggaggcaaggctgagggagagggacagtgtggaggtctggtccaactagaagaatccctaaatccacatagatggttgtaagcgacgactcatcctgcttcggggctggagtttgaccccaagtggatagtttcttaatcaagggtggcatacacatttcaaactggaactttggaagtgaccaagtagaatgttgttttgagaagaacaccaagactgcatctgaatgtggcgggtagaaggattgatggccgccattggccactggcatgcagtgaggactcgtcatatccgtggctcagtacttaccaccctgattctcaccgttgaatctcttataatttctctgatccacaaatgctgagtgtagataccaaaatatggaaatgagtagaatcacaggaaacaaattattactagatttaggacttaactattttaatgaattaaatcatggaaagatcaggttcacttcaacttactaaagcttattattaactttataacttttttcaagatatataattaagaaacgataagactttgaaaatcagaatttctgaagacttctcctgtggcaatatatcttctttgataacagtgtcttgattccattccctctttgctccttcagttacttccagggtcactgttatttccacctctccctctctattttctccttccaatcagcatttaagcaggctcaaatatctgctgtgttaaaaacaaaaattacaaaaatctttttcaccactgtctcttcctcctcgcctccttgccgtcctggagcgctgcctggacttgcgtcctgctgtgttccttctccactccttccgcgcacactctgtcctgatttctgctaccagcacttccttgaagttgttctcaaggttgccaagaccacccaattgtcacagggaagaaacattttgcagacttcagcttacttgaccttcctatacttcctggtgctgttgttcactccctttgcttgcaattctgtcttttctttgtttctacaatgttactttctcctggttccaccccctcctgcctgaccctcttttcctacctctttttgactataagcttttcccctttcttcacccttttcaaattccatttcattctaggcatctatccttgggctccattcccacccacctgatgttcttcccacatagctggtgttaatgttcacatatgtaccatcaccccatgtctgtgtctccaccgggactttacctaaatgtcctacagaaacctgacacggaacttcccaaatgacacctctcactctctccctcacctcaggtccgtttctcccactccccctactctggtgaagagaaccaccatccactcaaatttagctacttaagaatgagttaagcaacaaatcctctaaatgtcccctctgaaattgttctcgaatgcatcccctcccctccagctctgtagcctaaaaattaaatattatctggtgtgtacaactcttaatatagtgcctgacacataataagtgtccaataaaagtttcccctattactagtaattctgttattcctgccatactactgctattagtttgggctatgattagttttctcctggaaaaatacttgctctagcttcccaattccacctcacctcctcaggccctccttccctcagtctagcccctgccttgctgccaaagtaatatctgaaatataaacctgagcctctcccagcactgcttaaaagccccacccccccccccctctccctgtggcctccagggcatccagtcctaactcacaaagcctcttgctaagtggcttttcggcacctggtcactgcacctcctgagcatgcccccacaggtattgtatgcagaggccagggacctgccagcagttcctccaacaagccaagccccccacctgcatccctggtcttgccctcgctccaaaaactccgagaggcctcccatgccccttcctttccccatgcactgcaggccaacctccgtcccagcatctgtggtgagcacctgtgtgctgccattgctcttcacgtgttccttctgcaccagtgagggaaagactgtttctcctctgtgcctagtgcctagcacggtgtttggaacattatggggtttccaacagcatgagatgatttgaatgaatggttactggggaggcactttcacagctaggcttagttgaacataaaatgtcctaaactggactattatgaagaggaaagttttgtctctggctgaaagcaaaatgcttctccaaacctcaatccttcagatcctctgtgccaggctgggtttcagggcctggggatgcagaggtggacaacatgtctctgttctcatggagcttgcattccagcaaggaagataatgtcacacagtaactagtactgtgacaaggaagaggaaataaaaccaggtatgtgttagggagagccgagaacactagggtttgaggacacattacacaaggtaagagggggaggacaggggaggtgacagtggagctaaagccagaagaatgagaggcttcgtccaacataaaagggctctcttattacatcctagttaatggaaagatatttttgactttgcacccagaggctgcagaagaatctcagaaaatataatctggctttggatatgtctctcactgcactaaaatgttgcctgtggccctgaattatgtaagatgccagagcacgcagcataactgtagagaaacaggaattactctgccaggctctgggaaagccgtgcagttgttttctcctctctgggcctgcgcttcctggaacagccccagcctgcttctgtttggcggtctccgctcacagaggacagtgcttccccagaaggaagctccaggttcctgcacccatggcaggctgtgaagttgcttgtggctggcttcaaggcttcttctcccattcacctcaccttggccagctcagctcctctctgatgtgttcctgatgctcgaatttccctcctgcattttgcctcaatgcatctctggcccgcatccaaagtgatcatcattaatgttctcttctcatggatctattggccagatgatttctgctaaaagatttcactgcacttcccttgtcctcactcctccttccctttttcttacctccctccgagtgctctagctgatgcttgtcctagaccaactgttcctggcacattcttgcagtcttgacaatcagggaaatcgttaatacacacacacactacacattcacattcgtatgcaatgccttctggcattttttctgtctttgcagagtagcttccatttattatatatctacttcctctaattcacctaataaacctaggatgtagacacccttattttacaaacaaggaaagtgatggtaataatagtgtctgtcttatagtgttgttatgaggattaaatgacacaatgcatcataagcacttatgccagtgcttggcacagagctagccctcagtgagggttctgatgattcattgacctctcagtcaccattgcattttattattaactagataaagtagaagacaatacctttaaactagcataattataaaagctaggattcttattttaaagtgatttttttttcactagccattctcaagcctagtttttacaagccaaggaatttgccttcatcttctcatctctatccttagggatacacaaagataaacccaaaggtatttaggatggaaaagaggatgatgaccatccctcacatctgcatgagccctgtttccaagccaaagccttttgtccaaggctctgtaaggaccgttctcccaccttcccagtgtctgaggcataagctccttctgaggcctgacttgtatctgtattttctgcctcatcacttagacaaagctatgtttttcttcttctggaggttaccctcctctttttcctcccttcatctccaccacaaccactttgcaaaccctgcacaaaacattttcctaaaagcagcacacacacctcgaactgcattagaacttaggtgcaccaccgcctgtcaacagatgtccctcaaaaaactgccctccgtgtcagatgagtttgggaaaccttgtgtaaagaaaggcaaagaggtgtccttgctgctgggcttcacttagaacctctaatttgctaattaaggtggagaacatctccaggaggcgctggacaactagggcatctccaagggatctgaccggagcaccttgggcagggtcgcctttttaatgtcttgccagagcccagcatccttggggactgggggatgcaagttttggtagaaccttctgccatggcatgggtgttgggggcaatggcaattgagtgagatagggaagaacggggcaggagccctcaagggtcagctcagcaaacagcaagtgggacaggcccaagtggaaggagagatgaggaagacaggtcttattggggggcaggtattcacaaatcagagagaaaagttacattgcaggaggtggaatggcaagaggcaattatttccaattattagaggtccccaaattctagccacatggctgggactaagaaaagcaagcaaactgacaccacagtttaagaaaagatagacattgccaattttacctcccaccccctgaaatagtggccccggagaaacccctttctggatagatcccaacactgtcacctcctaacttgcagcctaggctggtcactgactgtctggcaatctgactttgcagaatttataacataggaataatgacggcaccctcctcctggggaggtctgaagcttgtattatagaaacaccccaacaagtgcagtacacggtgcatccattaatgtgactttctctctggtggattgtatttttgcctgtcattatctctggatctcccccaggtcaagaagaagagagattggccctagaaactgccctgatgtacggagctaaaaagcccctcaacacagaaggtgtcatgaaatcaaggtccaacgttgacatggactttgaagtggaaaatgctgtgctgggaaaagacttcaagctctccatcaccttccggaacaacagccacaaccgttacaccatcacagcttatctctcagccaacatcaccttctacaccggggtcccgaaggcagaattcaagaaggagacgttcgacgtgacgctggagcccttgtcctgtaagctaacaatggtgtggttctttctgagactcgctgtctggcccctgtcttgctaggtgttaatgcccgttatagctttatatcaaagttaaagttccctccaagatctcagaagtgtgagcctcacagggagaacccactcattctgcaaaagcctccactttctttttttttatttttattttttgagatggaatctcgctctgacacccaggctggagtgcaatgcgatgatcttggttcactgcaacctttgcctcctgggttcaagcaatcctcctgcctcagcctcccgagtagctgggattacaggcacatgccaccacgccaggcaaatttttgtatttttagtagagacgggatttcactatgttggccaggctgatctcaaactcctgacctcaggtgatccacccacctcggcctgccaaagtgctggaattataggcgtcagccaccgcactcggcccaaaagcctccactttcatcctcacgtctcatgcacagaagtgaacattgaaaatttcaaagcctagagccccatgagttgtgagaattaaatgtaacttcttgctactcaaagtgtggtccatgagccagctgcatcagcattccccaggagtttgaaaaaaatgtagaatctcatgtcccaccccacaccctctgaatcaaaatccatgttttgacaagatcccaagcagactggagtgtacaggagagtttgtggagcatggatctaaatgatccatctcagaaacaggccctctgctggtgcctctcgcccaagttaggaaagtcttttgggggctgtccagaatgaatagtgtgctttgctttcccattcaaaaagatacacgcgctgacataggccgcttcttaaaacgctgtctcctgtaatctcagcactttgggaggctgaggttagcggatcacctgaggttaggagttcgagaccagcctgactaacatggtgaaaacccatctctactaaaaatacaaaaattagcccggcgtggtggcaggcacctgtagtctcagctactcaggaggctgaggcaggagaattgctcgaacccgggaggcggaggttgcagtgagctgagatcgtgccactgccctccagcctgggtgactgagcgatactccgtctcaaaaaaaaaaaaaaaagaaaagaatggaggctggaaacaaagctgtgtcatctaggaggggcctaggaagaggttttctgcctctgccatctcttgtggggcctctttctcgtccttgcatgcacatccttccaagcattttcatcactgtaaaaactcagaatattttaagcagatcagggtccacgtgctacagcttgccttggggattacaatctcaaaaaatcacatttcctaggatgttcgtatttggtgggcacaacagttgaccacacgatgggcaacacaagtccattggaagaaactggtctctaggcagagaatgagttagagcaggttgcaaaggacctcgatactttggggcaccaatttctgttggcctgacatggggcactgaagagaaaagtgtacaaataataattttgacaaagcaaaggcaagcaaaactaatacgctcccctgggatggtcaagccacaagtctgaattgctctcaagctctctggattttgtggctgtcacagatcatggtccccttactgaggttttggaaaatattcccagaaaaatgagaaactattttttaaaatcctaattccaaggaacttactcaaatttgaaggaagcaaatctccccagcttcagtaatggagctaacaattaagaaatcactatagtggggccaggcatggtggctcatgcctgtaatcccagcagtttgggaggctgaggcgggtggatcaactgaggtcaggagctcgagaccagcctggccaacatggtgaaagctcatctctactaaaaatacaaaaaattagccaggcgttgtggcaggtgcctgtaatcccagctacttgggaggctaagacaggagaatcacctgaactcaggaggtggaggttgcagtgagccaagatcgtgccactgcactccagcctgggggacagagcaagacttcatctcaaaaaaaaaaaacactatagtgttttctttggaaactaaaagctttggcacttttcctattcctagggtagtaaaggtaattttcatggaaaagaatagtcagtgtaaaggactgaagaggacaacagtcatggggattgtttaaaacaggcagccacatttgatttcagagagttttgcaaatagacaattctggatgtaagcgatgactgtgtcacctaccagctgtgtttcctgagcaaggtacttaagcactctgagctgtctctcctcatctgcaaaggggaaaaacagcacacacaccccggggttcttgattcattcccctaacctttatttagtgcttgcaagtccaggttctgttttatgctggagacacagcaatgcctattcttactgaatttctgatctcatgggggaaccaaacaaacaagtgaatctatagtatagttatatgggtaatagaaaaatacaaagcaggttaaggaaaacggggagtacctgtggagatggtcagaaaaaaaaccctctctaatggggtgacatttaacagagacctgagtgaaggtcagaagtgagcattccagccagaagaaactgtatgtgcaaaggccctggggccagagcatgtctgatgtgttcaatgagcaggaaggagccagaatcaggaacaaaggtggcaagggggcagtgctgggtgcagaccatataaagaattgtaggcctttataaggcctttggtttttattttgagtgagctgaggagcctttagagagttttgagcagaaatgtggcataatctaacttaggttttgaaaagaccactggctgctgtgttgagaagagactaaagaggaagtagggcggaaggttagagactggtaggatgcttctgcaatcactccactgaaaggggttgatagcagtgatggaagcagcgagaaccagtccgatctgggcatgtgctgaaggtggagcccgcctgattggctgagagactggatatgtggtgtgagagaaggaaggtatggaggaagccaaatgagtgatgaatgtgaaatgtgtgccacatggtagaatcttagtaaatggtaacttccaacatgtttacatttggggaaactgaagctcgagagatgagtcgatgtgttcaagcccccacacagcaatgagaggcaaagcagataatagagtagacagataatagcagtgacagtgagccagttcagggtaaacttggccccaagtgggccaggtcccttccttgtgctcccattacctggagtctagcacagatccttagacaaagaaccaaatgccagcccttttcccacctcacaagtgtcctgtctcataatctccttccccttccctctttaatccaattaaagaatgagcttgtatgggtgagtagaatgatatcattctctcagtcatcgacctagggacagctgaccaaacctatgcctgagtccataggaacacatctcccattcgcttggccagccccaggttgtcctgaataacttgaagggaactggagactctttgttcctttgccctgcaggcaggtggtattaactgtgaccaataaattgtatattgaaatataaattaaattgcagtgtattgcaaaaagccacataacttcaggccttgatcaagcattcttagatgcctctgctgcaaagaaagctttccaagtagaatgggaggcatactttccagattgatgattaaagggaatgtgtgtgctggaatcagcttgggagatctgaataacttaaacctctccgtaccttcaaaggtgctatcatttccacttggctatatttagttttctttgctttttggaaaagagatgaggcagctccagtctgtgtctcccttggctttccccagacaccgtaaatgatattggcagcatcccagccctaccgctcatagagcgaaaacctattcctccttctcctgccacgtttaataaactttatctagaacaatttcttgtgcagtggcaaaacacagcacttacataacatactatttcagaagcactgttctcttgggctctgaagcacagcctggtttctttagtgctatgatttagggagtgttctacctcagagaagaaaggggtcctgatactgagattataaaggtagcaagagcctctgtaaagaaatcatatcccattagccaaaagaaatccagtggtcaaacatagtcctctagaaatagtcagaagaagtcattttattattgttattactggaaacagctagaggcaaaaggcatcttcttcgaggccttccaccttgccacttcatccattctatctagagacacgataaactgaccatttgtgctcatctgaggctgtaaccaatagagggccagaacctcactcatctaaacaattaattgcaaggggagccatggaggaagcagggtccaggcttaggtccaaagacagcaatacgagagcgggtcattccaaaaggcaggacctgggggccaaggtcaaggcaaggtcatagctttaaagagtcagctctaaatggaatagctctgccccaggaatcaagccaacaaagctagctctttagcgcttgcccaaaataggccaatacattctaataatccacctgccctatgcggggtttcttggtttcagcaccattgacattatgggctggatactttgttgtgggactatcctgtgcattgtaggatgtttaactgcatttttggcccctatccaccagattccagtagtaacccaccctccaccccagttgtgacaatcaaaaagttctccagacattgccaaatgtcccctggggataacattgcctcctattgacaactactagtctaggatgaccaacctttctagttttccagggattgatggggttctcaggatgcaggcctttcaatttaaaacccaggtagttctcagtccaccctaactctgccctaacttaccccttctgctgttagaacctcctgtctctcagagtatctcacacttcaataggcattgtctggggtcttattcaaatgcagatcctgacttcactggtgcagtaagaagtcagagaatctgcatctgtaacaagctcccaggtgatgatggtgctgctggtgtgcagaccgcaggaggaacagcaaagacctggactggaaagccatcccttccactggaacccaggctgtctgcagggctgattctacagggatgcccctggttgttggagtggcccttctcaaccctggctgcacatcagagtcagctgcagagctgttaaaaatacagatgtctaggtcctccaaggctctgatttaattggcctggaatgagagccagcttggtaggtctttaagggtccccaggtgattgtgatatagagccatgactgagaactcttcaatcagaagtcctggaagcaaggcacagcacttacgcatctgtaaagagacttccaaatagaagtgctgcccaagacagaggctttcccagcctcttggtcttcaaggtccagagcaagctgctgcagatccatcgcaggtgtgagagttcctccacagatgatgggcatggctcaatgcacccacaccttcgagccagtggggagtcaggggccctgccctctgctctggtgcatgcccatccacaggcaccccaccctgctgcaaaactgctgttcagtacagcaggctaaaatgaattaccctctgtgctcaaactgttggccatgaagctgtttccttcaataacttccacaggaaggggaagtctttggcaaaagccagaaactgagaaggaaagcagtaaagacattcagttctgtgaaggttcatagagtctgttctctgtggctggggatggaggaatgagtcacccattcacctgcggagtctgccagctgtcggcacatacaggcatctggctccaaccaggtagcagtgggtgcacacctgggctcagcctacagaaaaactgcccattgctctctagaatcctggacagtgggaaatgggagttagagagaaagtgagccagagccacaagatagaactcaccatcctcagcccagatggtaattggaggggagccaggaccactctccatcttccaaatgccattctcattggcttgtccccaggacctagaaatctgacatcagtgactggtttccattgagaaaacaattgtttggcacagaggtcttctaaatcacaaacagaggttcggagatagttgaatgcctttggtagaaactggtttcaacagcttccttctcttaaatagaaaaatcatatcagattggagagaaaatgtggaatgctacagagaaaatgtgtaggtagttgacaatttagtctgagtgtggcccatggcctaggtgagacacttcttatttgacaagggatcctatgtggaatgggggccttggacttcagcaccccacatgttccattttgggatgatcccggcccaaatcaaagccaccattaaaacccattggtccttctttgccatgaaaatcacatcttttccatggcatttcttttacaacagcaaaagaactgtttggaaggtttgacacattttctccagtgagacttcaatgaatattaaatttccagcacattctttacctaagaagcaggacagcttatccccaattgactctttgttccacttgccccttacctttgctgtgttcctggtggcttccaggctaatgtgggaggggtagggaaacttggagaaaagtaaagcagaccctgtctcaagtcttgatgccaggcctgtgtgtgttttctcctactagtcaagaaagaggcggtgctgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtcagtcttagcgtctcatcctggaacagagacaaaggcacgcagacttagtgttcatgtgtgcatatgcgtgcttgtatgtgtgtgtgtgtgtgaatgaatgtcctgctcaaaaaaaaaaaaaaaaaaaaataccagtgctaggatcctcttgttctttgaaagaagtaaactgccctatatatagacacatacatataacactttcctctcctctccagatttaaatatatagatgtggctgcagatataaatataacctgtgggtataaacacacttgtggaggaagataaagatgtgtaatggctacagatacttagaactttcagtgtctccagaataaagtgggtcaggcatgctataagaggtagataaactgcctgcaacattttggacagtaatattgtttatggaggtataattgtggatagtagattgcacagatcaaaatatacagcttgatgatgattttgtatgtgcgtgtgccttgcaaccacaagccagatgaagaaatggaggatttccaacacccctagaaggttccctcttgccttttacagccaataaccccctagactatcaccaagatagtaacttttctgacttttatcaccataggtttgttttgcccatttgaccagtagttttcatgatgcctctccagtgatcaccagaaatctctgcccaaatggctcaagagacttggcagaggaaggccgagggttgatgagagtggaagataaatgtgggagcctctgtgctcctacttctcaggcccacagctgtagcttctgggggcatctgtggttgcatccatgagacgccttcctgccctggaagcaggaacccaggcttctggcagtgaccctgaggagtgacatctcatgcagcccttatccaggtcttagagcccttccctagtctctggagaacaatcttcttgaagtgattaagagcaattagcacagatcctgctaaactacattgctctaaagtggtagataaatcaaagctttataaagttgatcacattttaatggtcctagaggtgggcagggtgagggtaggtagtccttgcttctcgtgaatcctttgctgtgagtcatttggaaagccaatgactgctgtgcagcattcagaatggcagtgtttcttgggtaactactgggctccagacgctgttcttaaagcactttacatggttgcattttcaaccaccaacaaccccacaaggtaaagagtactggcatcactttacagatgagaaaactgaagcacagagaggttctataactcctccaaggccatacagccagcaaatggcggagctgggcttccaaccccagcaggctggctgcaaaagcagggctgggaaccagctccttcaactgaacgttcttatggtctggtcctgtgtaattgacacagtgagccaccccaaggcaagtcccacccaaactcacgggcatgtaatgcccatcagggagcagaacaccaggcccttcttttctacaaaggcctacattgtcatgtctctttgtttccttcgcctctgtcatggcccacaggcccaccatggcgttgtgtgcacaggacgcctgaaaagaatgaaaacgaggctgtgcagggttggcaggcaaagggagaaacaaatgcaaaatggagaggtggggattagggttgctgcagaggtaccatcatccatgagaacgtgaagttaatagcttaaggtgcaggatgccctaaccccgaagctgttcttcacagctggctcttcctatagacatgtgggaccccctgctgcaggcctgtcccagctgcttggtggaagcagcttttgctacccttctgggctattgcgcaggtttcatttatgagctcaaccctgaaccttccctgacagcagcaaggcctgtgtgcgtacctaattatgaagtgacggcctgtccctgtgaaggtctcaggagagaggcttcccaagctgtgaagtgctcaaaccacagcagaaaatagaatttaattgcaccactgataataaaccggatgtatgaaggaaactgataactttcatcttttaggcactattaatttgcaggattatttgttagttatcttctgggtttacttaaagagcagtttaattccccagggcacaatcagaataccttatcccacaagttagcagacctgggcatgtagagagtactttaaatggagagttatattgttttgtgtttccttccacaaagcaaccagagatgctgttcctggaggaaacttatttagaggtagggacatttgatagggaagagagcatgagagagatggagattctggcttctgtccatgccaagtttgttcaaaaaggtggaatggggcatcatcccataaactgtcctttaaccattagcccaactaactccaaggataacctaaatccaaatggagtagaagtgctcctgggtaaagcactcacaccctaaggaccacccaggagtcacggagctgtgagaggccctgagtgcagaagctccggcctgtggactggggacctgcctagcctcctggagaggtgaaatgcagagtcatagcaggggagggaaggagggaggggaagggagggagaggagagaagaacagaggggagaggagagaacagaggagaaaaggatggagggaggggaggggaggggaagatggagaggagaaaaagaggaaagaaaagaggaaggcacaggaggggagaggagagaacagaagagaagaggaagggacaagagggaaaaaggagcgagaatgggggggagaagagaaaaacggggagaggagagtaataagaaaacttcaagttgaaatattccaaaggaggcctagggagaggggtcagataaattgtataaaacacaactcaattaagagttattttttctccttccttccttccttcctttcctgtctttctatttttattttagatttgagggtacatatgaaggtttgttatgtagataaacacgtgtcacaggggtttgctgtacatattgttacatcacccaggtactaagcccggtacccagtagttatcttttctgctcctctccctcctcccatcctccccactccagtagaccccagtgtctgtttgtttccttctgtgtgttcgtaagttctcctcatttagctcccacctataagtgagaacatgcggtattacgttttctgttcctgcattagtttcttaagaattatagcctccatgggctttttttttcatatgcttgttggccatatctatgttcatgtcccttgcccactttttaatggggttgtttggtttttttcctgtaaacatgttcaagttccttatagatgctggttattggcaacatcaccaatcatcagagaaatgcaaatcaaagccaccatgagataccatctcataccagtcagaatagctataattaaaaagtcaaaaaataactggtactcgtggggttgtggagaaaaaggaacacttatatacggttggtgggagtgtaaactagttcaatcattgtggaaaacagtgtggccattcctgaaagagctaaacacagaactaccatttgacccagcaatcccattactgcgtagatacccaaaggaatataaatcattctatcataaagatacatgcacatatatgtttattgcagcactattcacaatagcacacacatggaatcaacctaaatgcccatcaatggtagactggacacaatgcagccatagctgtaaaaaaggatgaggtcatgtccttcgcaggaacacgaatggagccagagaccattatcttagcaaactaacacaggaagagaaaaccgaatactgcacgttctcacttataagtgggagctaaaagatgggaacatgtggatatatagagggaaacaacacacacagggtcctattggagggtgcagggtgcggcgtgggaggagggagaggatcaggaaaaataactaatggctactaggtttaatatctttgtgacaaaataatctgtacaaccctcatgacatgagtttacctatataacaaacctgcacatgtacccctgaacttaaaataaaaggttttttaaaaatgaggacttggaaagggagctaaatgcagtaaaagtacgaaaccacaatggctcagaggtccagaattacataggatatgtttctctaaattctaagaaaacgctcacaccctttttcaacctctttgagcctggatggacacacaactgactgagcctcaaggttgctgtgggcaaatgtgccaggcacagggtgaaattatgtgagagacagagaggagaccacagcccttcctgctcagctcagtcaagataagggttgggaccagcccctggtgattatgatgacagcagctatgatttattaagcactacattattaaacgcctctcttctatgatcttatttaaccctctataccatcctacaaggaggacgttactataaccctattttactgattagaaaactgagaggaccagagaaggcagtgccttgtagcacagtggtcagaacatgggctctggaaccaaatcatctgagtttaaagcttgttttctgaacatcataactgtgtaaacctggacagatcatttcacctctgttggcttctgcattctcatctgtaagtcaaaagcaatggtaactctcctcctggggtccttgtgagttttttatgagtcattggatgcccgagtcacagtgcacacctacatatgttggttgctgctattattgccattattgctgtttattagtaactggcccgtgatcacgtgcctgttgagggaaggagagacacttctggcccaggtcttcctgacttggaagcctgtgctggcagccgctgggctacaatggaactatcacaaaaagcagaggtggtcattgactttgcagagagttttgtattcaagggaggagagatcacacacacttgagtggtgtgggacatcaagaattaagactgtagaaagatgaatggtctccaatgaacagataacgttcaaccagtagagatggatggagagaccccttcagatactaggaagaaaatgttagcaagggctagaggggaggtggacggcagtatgtagagcagtgagaagcgtgccttggctggggtggaggctgggagcagggatgagtaagggtaacctgaaaaagatagcttgaggctatgtggaggggagtctacaattttggatgagagctttatcatcgactctctgaacaaagaggcttcaagggagtttctagagtgggaatgtaacatgattgtcaactctgctctcccacaagtcggagccgctttttcttcctcccttctcttcaaagcctttgcccaaagcattgtcttctccaggaagtacccaactcagccttggaactggagtttcctaaaagctagtttccagctgttcttacctgattcccctttagatcaaatctaggccaatctggaacaatactgggctcacatgtctgaatccaagtcaccgtcaaccaaagcaggccagtggcttcctgtttgtgcatcccagtggacccagtcgtggattttactggtccctgtggtgataaagatggggcctgggctcaatagtgctcccagtcaaccattcccagcacccaccatgtgtgagtcagagtgtgtgatcctcacatggaaacaggcagagagagacagtcattaaactttaatgagcacacgtctctttccccatgctatcaaaatattttgatgagaaaagaaaatttcattacaatcagacatagaatttttctctgccttcccatgtgttgcttgttctctctctctctctctctctctctctcacacacacacacacacacacacacacatcctctctctgaacttcagtatcccctttgcaaagtgaatacactatgattatactgctccttctattaagtacagtcacatataaaacactgcactggggggattgacatctgtagcaatgtttgtgagaatgcatggcccacgtccagacctagtagctgttggtaaatgttctttctcctctgtagtcccatcaatgcatgggggttgcttagggcagcatgtgggccactggcctgaagtgggccagtggcctgagtgtggccctcacctagtggcatggaatctcttgaatctctggtcaccaggtgttgagtgtatgcagcattccctgtggaatggggccttcctcatgcagggaggcccgccttggagatcctggagtaaggcctaggggagagaggagacactcacatgttcctccaatgatctctactcagtacctgccattctaaagcagctcaggagccagcacttgtgtggtattatcatgtggaaaaagtcctgcagcctttgcaggatgtcaggaagcaccaatagaactaattttctcatgtgaactaggaacaattttgctaggagaaaacataaccattttttatgtgtgtgatttttaaagttacaagcataagcaaacagatgtctccaaatttttcaaaaaaaaaaaaagcttttaaaatgaggacaattgactgtttccaagagtttttaaaagtaagcgtttgctctgtatttattttgtccattagctgaaagactttctagtttttatttatctctttatttagtcactcttgcattcatccattcttcatatagttatttggtgcccactctgtaaataaattgtagcaaatgcctagagctttcaaaaccattatcagagaggccgggtgcagtggctcacacctgtaatcccagcactttggaaggccaaggtggctggatcacttgaggtcaggagtttgggatgaacctgaccaacatggtgaaaccctgtttctactaaaaataaaaaattagccaggctgtagtggtgcgtgcctgtaaccccagctactcaggaagttgaggcaggagaatcacttgaatccaggaagcagaagctgcagtgagccgagatcccgccactgcactccagcctgggtgacagagcaagactcaaaaaacaaaacaaaacaaaagcaaaacattatcagagaaaaattcaacagtgagaacattttctttctttccttttttttttttagatggagtctcactctgtcccccaggctagagtgcagtggtgtgatctcggctcactgcaaccttcgtctcctgggttcaagcaattatcctacctcagtctcccaagtagctgggattacaggcgcccaccaccacgcccagataatttttgcatttttagtagagacagggtttcaccacgttggccaggctggtctcgaactcctgacctcaggtgatccacccaccttggcctcccaaagtgctgggattacaggcgtgagccactgcgcccggccaacagtgagaacatttttgttgcatttttctgaaatggggaaaggttgcgccactttctttcagcactggcccacctggaacagctccaggagtgcagttgctctgttttaacctgagctaaccagcacttacacagagcctggggtgctcctcttgcaaagacagtgtacatggggcctgtgaaagatgcttaacccacagaaatcgacttcaacaagcagaatatctgcatgaccagcactgattggtggggaattgtatagataacacaagatccatgggaagtatcactgttgaccccggagaggaggcagggaccttcctctgggcggcttccctccaggccagcactcacccctgtgcagattgtgcccatctgcaggtgggaaggagacagtgaggggacccagtccagcccactcgccaaccatcaagccctgcagcctggcatggagccacatccccccaaaaaagggggttcccttttccactttgcacagttgcatcctggctccagccccatgtccagatctcttccaacttgggacactagcttgttttttcttaacaaccatcctaatgttgtgttctaactggagcttttcatgagatgcccacaatttttaccgaggttaacagtagaatcctcttcagtctccctacggctcacaccctggaaacccaccgggatggaccaaggaagggtgggtggctgtggtggctgctgatctcactcctcccacatcccattcatacaactttatcccagaggacacattaaaattggggaaaccactgggcacggtggctcaagcctgtaatcccagcactttgggaggccgaggtgggtggatcacgaggtcaggagatcgagaccatcctggctaacacggtgaaaccccatctctactaaaagtacaaaaaattaggcaggcatagtggcgggcacctgtagtccctgctactcgggaggctgaggcaggagaatggcgtgaacctgggaggcagagcttgcagtgagctgagatcacaccactgcactccagcctgggcaacagagcaagactccgtctcgaaaaaaaaaaaaagaaagaaaaaaaggggaaaccacttgagatataatgagtgccccaaacaaagtacatgacagtgactggctacactgtgagacttaactgtagtttcatttagtgctgtaaatatcacaaacttcattaaggtggaaaatgggaacagactatgtgttctaattattgctgaaccctgaccattttcccctccatgtccacaaccgagcacgttctctctccagcctcctgcactctctgtggctccatcgcactctcgtcaccaagattcacccctgcccacacccacacccttcatggggaggccggggatgggaaccaggaggtgggcttcttcacctctcccctttgtggctctcttctctaacccctgagaaaccgaatccacgtcattctccatagaagaccctataggtgaggaggttctcagggtcaccctggcaacatgttctccctttaaacctcatatttcattaatgctagtatgtgtcagatgctctgttgtatgatattacattgagtcaccccactaactgcataagaagctgaggcccagagaagtcaagcgacttgtctaaaaactcaaagtggcagccccggtcttcagcccctgcatccagcttgctctcccttcagcttggcctggaatagcaccactgtgtgcatcccagtcacctcagttatgtccgtgacactgtttcaggttatttgtggagtaaatcagaggtatctacctatgagtcctgagggactctgagcaaggaaagcctgcttaccccaggggaccctaggaggggacaccttcagccctgctcccatagctgactctccatcccctcgtggctactttcacagaggattgtggccgtgggaccaaaccgtgggtgcccttagccaggatagatgatcgtaaactatgtctatgagtgagccctcctcatcgaaggtgttcatttccatctctctcttcaggacagctacagaacagtacacattttagaatgaaaatgaggagtcactggtaactgcggtacctaaaacataatttgctctgtgcatttcatgtttgctatttttttgaatcttaaaaagagacacacatgagaataaccaatctcacattccagtcctgtaatcccagtatgtttgggctactgattctctttttaaaagtggcatctctcatttttaaaagagaaaatcctagatagtgactcctattatcatcaagtaatatatatcaaggccccaaggctaccttgtcacattttactctggcatagaaatctaattccttctctataaagtcaaaaagagagaggtgagttatagatgttttctaatttagttcagggtcaacttataatcctcgtcctcaactgatggtttagcgataacttaaaaggtgatgctgcaaatgattctttgctggatttcagaaaataaagaagctattccagcaaaaaaaaaagtttctatttttacctgtattctgtcagggatcacagtataggtagttttgaagatgaatgttttagagtcagaaagacctggatttatatccaacttccgccagattcctaactctgtaggctttttatttatcttctaaatttcaatttcacgtaaacagaatgggattaataatcatgtctacccccaagaccatagggctgtagagaagattaaataaggtagtgtaagtaaactgatgaacagaatgcctgcattactaagtaaacactaactaaataaatgtaagttacttgttattattgttgtcattaaccagagtcaggatcacgtgttgctgagcaacggctatggccccagactgtctacatttgaatctctcctaccctacttactaatggtgtgaacttgagcaagttacttaactcctctgtgcctcagtttcctcatctataaaatgaagactcctaatatttacctcttagtgttgggaggattaagtgagttgatagaactttctagggtaatgggaacattttaaatctgctccatccaatgcagtagccacgagccatatgaggcttttgagtccttgaaagatggctcgtgcaactgaggaactgaattttttacatttcacttaattttaattaatttaattataaatagccctaggtggctagtggctactatattggaaaaatatagactgagaacatttcctaaccaccctagaaccattagcattggtcagtaagtgttcatctaagtgtcagctaaaagcaggggcagtgcctgtggtgatgagcagagtttgcaaacaagaaattgcccattatcaaaaatgatcacaggccaagggggagggaaaaatacagtttccagaaatacgtgcaatacatgattgaaagtacttgaaataagagctgttaggtgtgctaataaatcatgtatttcaaattgccaacctcacttattgttactctttctcaaactttttccttcatttcagtttcaattttgaatacagttatgtatttttaaagcatatgcttagtggaagatatcttgtgatttctaaaaaagtaatttctttccaaaaagtttatataagagaaagagagtatgtgtgtgttagtaactttcttgtttaccaaagaatcagagtagcagctcattatcatgaattagtataaaggacaggaatgtcaatatcagtaagtgatatgtaacttgaaaaagcatactacgggttgatttttttaaaacagagagagatattttcaatagaatattgagaaaaacttaaggccatcaagtatatgcaaaagcatttgacgtcaccaagtaagacatatgctttattcttttctctggcccaagtaatgaatactcttctctaaagcaaatacacataaaagtttcttcttgaactaaccttctctaaattgcctgaaggctccctttatttaaggttttatgagagcaagaaaatgaaaaatatgactgtgaaaatgaaatgaaaatatgactatgcagatatggaattatgctttcagcaataaggaaaagggagctttgcagattcctaaaataatgtgatgcaaacagatattttctccccaaatagtcattgttctcagcattttgtaggtaccatagcatggtgcatcactgaaatcaacacataacgtgaaaacactatgtgttggcagcattttcctcaaaagaagcaaggagagggagacacctccagttacatttcccaagcagaacacagtgatgtcgagcattgggtaggtttttacatttagtttggtttgagtgtctaaggctcattatcatcagtagtcagggacaggaagtttacattctcggtgcaggagacaagtgtcagaaaagggacactggtctttgttaattgcaaaagaaacacactacaaccagagaagggcttctcctctcacccctccccatccttctccctgctccccactccagcatcagggaaatctgggcagaattgatacacccatgccagcatctaattacagagacaatactggaagcaaactgattaggcatgacatatgaaattacctgagaaggtttaatgtcctgaacatattcagatctgaagcctatctatgatggcccaattgcatgggccagtttctcaaatactaagcattccttctcactgtcatcagtgacctggaagggtgtatttcactttccacagcgtaggaggcttcatgtagagccagtctactggtatgggaagggttcttaatctagggttcatgggcccctagaaaaccatgtatggacttcataggtctatagtgcatcccctaaaaatacatgcccatattgtatatatcttgtatttgtcactgtgtatgtctgtgtagaggaaaggtcagtagctactatcagatatacttttgaaggggcttatgcccatccttatatagcataccatggagaagacagatggctccaaaatattttttccagaaagaatatagtgatcatagcaaacacttttgccaataatgtctctgtggcagctccatcttcttcagtttagagagcttttgtaaatgctatctttattttgtattttttaaatccaaagatgtttttgaaatgtttcttaatgcaggaaaaaatatattggacacacttgagaatgaaatcagggacaccatgtaaagtattctgatgtattgctacaccttcaatatctaaattgattgaggcagggcctctgggaagaaagtgaaaaattcagtctgtcttccacatgttttgtctataccagtggtttccaactggagggcaattttgcttactaaggaatatttggcaattgctggagacacttttggttgtgatggctggggtgcggggctgctcctggcatgcagtgggtagacaccagggatgttgcttaacatcgtacctggcacaggacagctctgcaacaaagatgcatccagcccgatatgtcagtagtgttgatgctgagaagccctgatctagatcatgattactgtttttgccacagccttcaaaccaggcttctctctccacaccccatgtgccagccagcctaaaagtaacttctggttcatgttctagtttgcctgtcattgaaccagtctcctccccattaggccttatccattctcagtcttgtcagtgtggcttcaaatccaatgttgctcccaccggtttgaaaatctcccttactttctgactgccgttttttttttttttttttggacgtcagtacgaaacagttttggttgtcttgttattgctgagttgttggcttttccagctcctctgacctcagagtagcactctatcttagagttcaagatctccagttagacagactttaacttcaatcccaccttggtcatttggcagcttcaaatcctcattcaagttacctattttcctgaaccacagttttctcttttataaaatgaaatgcctggcaccagtgatcctgccctagaaaacctccttcttcttaagggaataactattattatagtctgatcgagctgatacaaatatagcccttgtgttgtgaggcttatgtgagaatatatgtgaattatggttgtcagctggggctggttctttgtaatcaacaggggtgcctcaaataaatgaattacaggatccacccattaccagactgaggattgctggttaaagtgctggactccctgcctggcacacgatccatgctgtctaggtgcacctgctgttgttgctaccatgaccatcgtctgcccctctcctagttcccctgaatccagctctccaccactgccctccaggagatgcggatttaaatgtaacaaagtttagggagttggctgaaagtttcgtttttcttatagacttaagaaatcccatagccataaatttagtcacaaagcatggcttgatgagtaaagccataagagtgtattcttcttttaatcgatatataataattgtacatatttatggggtacatgtgatttttcaattcatgcatacagtgtgtaatgatcagatcaggaagattttattcttgactgtagcataagtaagcaagggtcctcttctctgggcaatgtccttcctctttacgtccattcttaaaaacgcctcatttccatatattttctcccatattatatagtggctaaaggaacatggaatagtaatggctgtgttgtcatctggaagatccagacatccagtaaattccatttttgagccattgacttaatttaataaatatttactggacattggtattgaagtactaagtattggagttaaaagtgggctgaaatataaggtgaataagacaaactacccagagcattgctaccctaaaaagcatcaactgtaatgcattgggcctttgccatgtgccttgcaatatgtttgccgttttatgagcatttttcattccaaacctttcttgcaagggaagaactattattcttatcttattcccaagttacttagagcttatacagatccattcatttggtatacatagctcctaaacaaacaaacaagtcttatagccacctggcattttgcggcacattgcgtttatgttggaaaagcatatggttctaaagtgtgtggcatacagtaaacacagcttaaggtatagtaataataagagcattctacatagatcgccccataaaagtgtcagcccattttaaagacaagaaaactgagtctcagaaagcctaaatcacctgagtccccactgttaataagtgttgaacctggcactgagctctggctgtctcctgtggtgttcttccaaatacctgatacttctgagagtcataatagatcaactcaccaacaaataaccttttattttcctggactctggtactgtggctgtagaagaaaaatctcctttacttattttagtatccaggttcctcttcatgttcaacagtaaggactccatccttggcatatttcttgcgaatgtgtctaaaactaagaaggcacatgtgccctgaagcattttctacttcttaaactcaggaatcccctttgtcccagcaggaaacttgatgcctatccagaagcaaagttcacttggccgccctcaccgtggaaacgtgttgccacaccaaatgaacttccccctcctgctgtcaaagagcagtcagtggccaccgctattgacctgagctctaattaggctggttttataatgaggaaaagagtgcgattctaattagtaaatttccatctctttctcaataggtatcctccagtcaaagcaatcagctatcctcatcacactggttccattgccaaaaaaataactgtatcataaaactctagtaaaagtgatgatggttaagacaacaagagagcagaacgaggttttatttggtgctaatgacctgcattctctctcttaggtccgtggcactcaggtagttggttctgacatgactgtgacagttgagtttaccaatcctttaaaagaaaccctgcgaaatgtctgggtacacctggatggtcctggagtaacaagaccaatgaagaagatgttccggtaaaccttgggttggggagaccgggcaggcagtgcagggctgtgggaagctttctctgtgtgtgtcttttccaaacatagatctgctccccagtgaaaatgtcttggaagctgcctcctccttgccgaccatttctgtagggcgtggagtaaaactagggttggtttgaccagcactttcatcatttaatccttaaagacaccctacgatgtagatactgctattatctcccttctgtagctgaggaatttgaggctttgagaggttgactggttacacaggttcagttacacagtttatgaaaacagagccaagattcagactcaggctggtgaattccagaacccaagtttgaaccactttgctgtactacctactcacgtatggtctcttctcatctttattgagctcctaccacgtgtcagatattatgctgagagatacccccttttcatgggtgctttgtctccagcctcacctcacagattttaccatcccaatcagtgtctacaactgttggattcaggtttttttttagttgagcctaaagagctctagatggttccccattcaggggaccaaagacaaccccaggttctgtaatgatatgaatgaaactcagcctcttccacacacaggccacttcaaattgtgcttgacaggtctcagtttctgtgacttctactaacaaagagtgtgacccaacaagataacccattccatggtcaggtagctctaacagtaaggaaacaggtttttctaccatttgatcctgccaatgatcctaattctgccatctggactgacagaaagtaaggcccatctcttttccatctgatggtttgcaaatgtttgcaaacagctgtctcatcttccttgaatcttttctacctggggacaaatatctgtcctgactttatttccctctcctctaacatggtttcagctctctctctctctctcccacacattccaatttgtcactactcctcttaaagtgtgacacccagaatggatcccaatctttgaggtttattactttcatttctaccacaaataagtccttgtcagcatcaatcaatctagcacatttcctgtggagtgaccttctaaggcatagaaagggaggtagaggactttggaaactgcctcatgaccagatatgtcaagaattttcccgacaccctttatggaagcgaccccactctggaatctgtgggataaatgcaaggcctcacttataccctctggggcaactttattgcccataaagggctctccgcatttctttcaaattacaatgctcgtagcttctgcatctcatcatttaagagatgccttattgcagatgcaataaacaacagagaaaataatcttagtgcttttgaaacaacgcaagcacaaaacatagcaaccttcctgtgctaacaggaaagttacaggaaaaaaaaataagtaaattagtaatcaaccccagctacatagagaggtcagcagccatacccctgctttcgtcagaaacgacagtctcactcacccattctcgcaccttcccactcaaatcagatgcaagaatcgttcaggcaaagtgaaacacgtttcctcttccatacagccccctgctgtatccaactttttccttcccagacagtaaacccacaagctttatctgagtgtaccggaaacttctctatctttacaccttggctatccccctagaattccaccttggtcaaggccaacacatgaaaaaagacactgtgtgtcttagacaaaagatgaattattacacagtgaattattacacagtgcaatgacccactatttgggaggcctcaggctcaaaataggttaaatctccagatggtttgtttattgttaatgtctgacattggagtggagcaaagtggagtgaatcgggagaaaggatggataaggccagtcccttcttggacacagatgtcctgcccacacactggcttaaggtactgttagtagttactgcaacacgtaagtctaggcagacaagtagatagacagagagctagctgctcttagtcagtttgagctgctgtaacagaaatgccatagactgggtggcttatacaacaaacatttatatctcacacttctggagtctgggaagtctgaggacaaggtgccgaccaattcggttcctgatgagggctcccttcccagcttgcagatggctgtcttttcactgtgtcctcacatggggcagagagagggagggcaagttctctggcacctcttcttcgaagggcactaatcccatcatgagccccaccctcatgacctattctaatttagttacctccccaaagctccatcgctaaatggtatcacactggagtttgggtttcaacaaatgaatgtgtgaggaccacaaacatttagtccgtaacagtcctcaatctctctttttaagttttttttactgacacattgtaattctacatatttatgtggggcaatttgatgtttcgatacatatatatgttgtataatgatcaaatcggagtatttagtgtatccatcaccccatgcatttatcatttctttgtggtgagaacattcaaaagcctgtcttctagctcttttgtaatatacaatacctactgttaatcatagttaccttatcatgcaatagaacaccagaacttattcctcctatttaattgtcactttgttctcattggccaacctcttcccatcttccccttcatgttctcctcctcagtctctggtaaccactgttctgctctttgcttctatggtataataatttttttttttttagtgtctacatgtgagtgaaatcatgtagtatttgtctttccatgtctggtttatttcacttaccatgatgcccttcctccaagtctaattcatgttgttacaaatggcaggattttattctttttatggctgaatagttacagaaacccagcttcagggtggaatatctcccagacaagagaagctttatttctcagagacagtcaaaacttgggctaaaaatcatgacatagaaaacatttgttatctaagatgggcttacaacttggagcaagtgccactttctctgtttactcctcactccagcacacaccttcacaaccaagacctgagccagtccgtgcccacttccatatggtcagataattagaagcactccactgtgccctatgttgccaagatctgatctaggagcgccagatccatgtaacaacttggacgcctagaaagtgcaattccacaaaaccaaaatcctttgcaagaccgtatttctttctagaatacagctcttaaatagttggggaatcaccacccccactcattcacccacaccctgccagatgtggtgtctagaaggcaggggttattgaacccaaagcagagggcctggaaggtgaggagctggtaaacagggaattggagccaggaacaaagaaggcggtgctgtgtctcacccctcactcgcagtgagccaactctactctgaaatggtttatcttcctgctcttcccccactgcctccggcctgtctcagatgtgcagaggttccacctccacagactcttaactttctgcacttgatgcttccagagcgtcaaataatttatcttccagatttattttgctctttagaaaatgatccagttcaatatgttatttcaagagaaaaactcccccactttgtgatttgggcttaaactttaagtttctcaaataggacagaagctaaggtctagaagcacagaggacaaaccatgggcagttgcagtttattgtaataataatcttatttgcctgcgtgcattcaagatgataaatggccggtatctcctgatggctcagcacgttactgagaatcgtttatcacaacatccatccccagaaaataggattactccaacattgctccacttatcaaaatacttttttctctgttatgaatttatctgtatgtaaaatagcatgcatacgtatcttcatgtatgagtattttcatgtatgagttttttcgtatgtacacatcattatgccggatggttttatgagtaagagaaaatgataagagggggctaaatacttagcttctatttgaggtggttatctacagtacatggtctcaggtcgggtccttaaccagggccactgtttcacaaagtgcttctgattgatcacttgggggaaccagaggagagagaatgaatggatacaggtaacaatagcacagctgttgagaaataaatatcccaaacttatattggtattgaattgagcactgagaattttctctctgcatacaggcaggagaaactttcctaaattatcttgcaaagagttcaatgaatcctccatgaacacttccaggacactcttattactaagtcaaaaagtatctttcctgcttgagaaataaaacctatgaaaaagtaagcacaatggtcagaaaaagccttttcttcttttctttttttatttctataggtttttggggaacagttggtgtttggttacatgaataagttctttggtggtggtttctgagacatttggtcacccatcacctaagcagtatatactgtaaccattttgtagtcttttatccctcccacctttcccctgagtccccaaagaccattgcgtcattgttcattgttatgcctttgcatcctcatagcttagctccagcttatgagtgagaacataggatgtttggttttccattcctgagttacttcacttagaatactggtctccagtttcatctaggtcactgtgaattccattgtttcattcctttttatggctgagtagtattccatggtatatgcataccacaatttctttattcactcattgatgggcatttgggctggttccatatttttgcaattgcacactgtgctgctataaatatgtgtgtgcaaatatcttagaaaaagccttttcttatagaacatatggtgtacacttttatgaagtgcagtgaagaggagcagaaagagtatgaatatgggactcagaaaaacccgggttcaaatttcatctctgcccatttaccaattatgtgatcttgaaaaagggacttcactggttaccttccatttttcttgatcataaaatctgctgaatagtatctgcctcaaagaactgtcatacatataaaacctgaatataatctcccaaggtttataggggaggctatatgtgaagcaccccagagaacactaaatctcaccaaccctgattagtctcagtctgcactgatgtgggcttgttcgtgacactcaggaagacttcagggcaaaggctgggaggaagaggagaacactagaaccatgaaaggctatgtcattagccgcatacattagggcattggcaacaaatggtagcagaaagttgcataggtggaggggcccaatttggtggttgaaataggaatttgaattacagaacatgaagattctcaaagtcaaatggcagcaggcagggctatattccagatgctgagcctgggaacaaggtctatcccaagggagttggcaaaagctaattcgagtgtcagggcctcagcaaaggcagctgggggattcatataggactgtaattccaggaggaaactagtggcaaaaactgagctgaggctcagaagatcagtcacatagataaggctactatggagggcttggagacaagctagagttcagttgattaatggttggatgggaatcagcccagctcctgatggccactgggaggctggcggatgcatcccagtggaaggaaccatgacccaataagactgtcagtgacaggttctgcagagctttatgtgggggcctcatttggggcataacttgctgaatcagccagtgagagtcttcagtgtcctaagcaccaactgagagaaagaaagcaagtgacttaggcaagagttttcattgcttcctgatcaaagtggaaagctggatcttccaacctctcctctcttttccatcctttcagtgaaatccggcccaactccaccgtgcagtgggaagaagtgtgccggccctgggtctctgggcatcggaagctgatagccagcatgagcagtgactccctgagacatgtgtatggcgagctggacgtgcagattcaaagacgaccttccatgtgaatgcacaggaagctgagatgaaccctggcatttggcctcttgtagtcttggctaaggaaattctaacgcaaaaatagctcttgctttgacttaggtgtgaagacccagacaggactgcagagggctccagagtggagatcccacatatttcaaaaacatgcttttccaaacccaggctattcggcaaggaagttagtttttaatctctccaccttccaaagagtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcggggtcaggttctaccctccatgtgagaatatttttcccaggactagagcacaacataatttttatttttggcaaagccagaaaaagatctttcattttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcacccatgttgagacctcagcttggcactcaggtgctgaagggtaatatggactcagccttgcaaatagccagtgctagttctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatactgggggcaaaatcagaatggaatgctctggtctatataaccacatttctaagcctttgagactgttcctgagccttcagcactaacctatgagggtgagctggtcccctctatatatacatcatacttaactttactaagtaatctcacagcatttgccaagtctcccaatatccaattttaaaatgaaatgcattttgctagacagttaaactggcttaacttagtatattattattaattacaatgtaatagaagcttaaaataaagttaaactgattatatttgca

SEQ ID NO: 201 - DNA, 7114 bp, Homo sapiens
aaactaaatcttttgttcaccagctgctcagcttttcagtctgggtctgagctgaaacctgctgcaagtctgacggtaagactttctttgccgatattttgggaatctaatattgttttagacttcgaaaaggggtgttgttcaggttgcacgtttctaggggctttaagcactcgcaggatggcgtccaggacttagatcttgagaatatctcttcctgccactccccacgcccttggctctttaagaataaaaagaggtgggggagttatagtcctccaatatcgtcggaatatttttttgtattttcattgtgtttatggtttcaatatgtgctctgatattaaaagttaaagtacaaagagcaacactaaacttccccaactcatgtagcttctctatggattctgggtgaaagcattaaaggctttatttaaagtgagatttaggcaaccacctcaataaacctaaccagaaatatttacataatataatgctgtcaactaaaagcattgtggaaaatgtcagacaagacagactaaaattactcatgatctgcagacatcagtacaaaacatccacaacggtccttttggtttgcattacattggtttagaggaagctaagcaattactaaatgaatggatttgaatttaaccagtgtgttgcaggtaaccagcaacaagcacacacaaacctttcatctcccgaggctgccacttcttcttaaacctgcccagtgactgtgctggattttttctcactcactgtgtcagatgttaacaacctgtccagaagtttctctacaacctgccccagtcagtcagcctctagaactgtggggccagaaacctgggaagaaaaatttaagaaaggttagaaaaggaggaagtcattccaaaggcatgcaatgaaaacaaagctagcaagaaaggtctttttaattgaagacacagaacatttaatatcagcaaaaattatgatgtccagttttcttatagaaaacagaatataaggaaaatatttggaaggaaaaaatgaaggactaaaaaggacgtcttggtgaattccagaattaaatataactttaattttctctggatttctaaatatgtattaatcattacataaagatttttaaattttattagaatatttggaataagatagaatattgaattttatgttctaggttatagagaaatttttaaaatgtagtaacaacgggaaaaaaatccctagcatttcctataatagctacttcagtgttcacatccataaaatccaatattgaaaagatgcctttttacctaatgatatcaagaagaatggtaaaaattataaaatttattataaaatttctatataacaatcatttacaactatgtatgatatagtatttatcctacatttataatatacttgagttttcctgaagataagttatattaatgccaacatttcatgtaaggtttcaatatcaagtaacacattataaagaggttgattctgtgaaaaggtaagctacttagctcttgcagggtccacagctataattattttaaacgtaggctaggttctttaaacttgataagtgtgtatatctattgtttcctcggcttaaataaaatgacattcaagagtaaaggcagagatttctttttattaggactattttattttaaggggactagagctcatattaagcaatacaacaaaattgtatttaaattttactttaagattcacaacgattcttttaaaagttgccattcttctgcacacgtgtgacatgagttgtcatggaacttcaaatatttaaaattaaataggaaactctactttgaattttacctaatagataaattttccttggtaacatatactcataatatatgaactaaagggtggataattaaattaatgttgtaatttgtttctgaaaactttattgggtatagaaatattatttctgctatattttgccaaaaagtagcagttatgtccttcagttggttcttctgaaataaagaattttgaaaatgtatccaaatatgctaaatacccaatggtaatttatgtgatttatgatgtacattattttataaaactaaggaactgattctccccaggaactatgcattataaagtttatggaacaattttgctatggctaatgcatgttatttagtgattctgtatacttttacacatttttaaaatgttattatttttatataacattaattggtacattcacagtaaaaattgttacattcattttacatgtaccaaaagaaatgaatacttaaaaccttacttctaaactgtaaaacaatccaacgtactttgtttttctagtttctaggtcttcctgcatttaaatttatttctttcaggaattagtgtttttcttccattcaattccggtatagtataatcaatgaaattgttctcaacgctaaatataactctgcctaaagcaataagagaggaaacaaaatatatcaaaattagaactatttaacggatgatctttagaaagccagcatgcaatatagattatgactaataaaattaaatctaaaagattgaattaaaaattcaaaatatatgcattctttcataatatgtattcacacttaataaaattctaatgatctcttgtctttctttttctttttttattttgtgaggcgtcttatgattgggaagacatagattgcctctcaaatttcaaacacttccatctggacttccttttgttcacctgttttaaatccataattatttgatagttaactcataataatgctaatagacaataattaatttctacattttcatttgcattcacgttgtatgttatttttattgataaatgtaggccttttcaaaattttgtcattgaaaattatatcctttccataacagggagaggtacaggcaaactaattcaagagaattctataatgaaatgctctatattatgttatattttctatagcatccaactcataaccattacatttctatccacaatttaagggaactacaccgtttatttctcccatgtcttaaaaagcaaggctatccttttatatgaattgaatttagaaaagttcacaaacctcagagaagaaaaattgaatcgaaaatacagacaggaattataagtaaaaccttagtcttctgttttaagttttccaacttgaagagttcaacataaccaatgtaactttggcactatgataagtttttcttgtgtgtttttatttttcatacttcatcaatttgtagcaagttttattcttaaagtggcttttccattttgagctcaggtttatgatttggattactaaaaacctctgtgttttagctgttagtatagttctccaaaatatttaattgcacactcatattttatatgattcagactcaacaaagaaataccagctgccttttatgtcaacttttttttttaggaataaaggaaaaatgttgtatatttgtataccaaacaaaatgaaaagttaaggccaaatacaagatctcttataaaagcatatttttaagagtttaacattataatagtactttgatggagcacaggttttttttttttttggaagattttgagagtgatatggagtatttcatacaaggcaatggctttatggaaatggatcaaaacaaggatgaaatgattaaatgacaactgtctgcccatgtcttaattaacataagaaacaagaaaggtaacagaaggtcagaatgggccaaaaaaaaaaaaaaaatcagaagagtatttagcaggtgaaaagacagaaagtgagacaagcttaaagatattaaaaataattttaaatttgttaatacataaattgtaagccacatatgatcatggtaaaaagattccaggttcatatctcggtttaattggaattttaaaaataagtaatcagaaaggttcatatttaactgcacggcatatatactgttgatagaagtaataatgaaatattactattctgagaaacagtttcaaataattaatgtgaaatgtggatatagatgtgatcaatgcttagacatgtgtaggctattgaatatctgaagttctgaataatcactaccttttcgtcttacaaatttgttacctgaaactcattgtaagcaaaaggtttttctaaatttcatctatttttagaggatgatttctgctaagttggggtcatagtatatgggaagggaataagctggttttcaacagctgttagtgtctgaggaaaaaaaagaagtcctgggccaactgcactgtaaagcacttcaaagcacaagtaaggaaattctgtaccaaacaccaaccagaacccaggaggaataccagctctgagctctaaggcccaagacaaggcaatttctcataccaccagctaacagttgttttcatccacaaaagggcctgtgatcaaaacaaagctgtctctatattatataagattgtataaatactagatgcaacctcttcaacccttagagtgactagaaaagattcttttttccccaccggacacgcattttgcatgacctttgtcctataagctcaaagttgcgggactctacgttggtccaattccacttctaacaattcattcttgagggtataaaaaaactaatgggtagaaaaagagcacagtgactgaaaaggtcaaaataatcttgtaatacttcatgataaaatagaatcaaactgacaactgatgttgaaaatggactttatgagtaaaagaaaactgacaggtttttcctctaatttaggacatctgtagtaatctgaagcagcatttctgcaaataacttattaaagatgattaagtgtgctggttaaagtgatggtaatgtttctctgaagatatactcaaggtcaaattaaatagacttgacccataatcaaatataataatacctctatttattgcaaacaattttaagaacattcctttgctatagtaactatagagcaataaaaatagcacatttatgaccttccatgttaattactttattcatcataattatcatctgtgggccagtagtacctgtcaatagcttgtgaaatgtttgaatttctacacattttgttcttggttacctctgatatcctacctcttacagttaatgatgcgatttgatcaaagttgaaagctgagtcattttgggttttaagatctgatcataccttcatcagatagactccaccaggcaaaggtctcaggcccaggtagcaccacttggaatccttccagaaccaaagacaagcacataagttttaaaactgcaaaaatgttcactgttgcacatgtggtgataaagcctatttttagagaagtgtgtatttttagagaagaaagatataaagaatcacatagaagcttgtaaatattatgcactgtaaatctaaggttattgaattagctatttctctttctgtagcagtattaaaggcttgctaatctatgtctagttctgttatgtgaacaatatttttcttaagaagcaattgttagatcactgtaatctggcatttgtgtcaaatatagcaatggctagaaccaaaaaaagtgggttattttccttgtactgtactagcaattccagtgatcaaacattgctaaatctcaattttcagtgagcaagtcccatgtcagtctctctctaaacagccttattgacaagtcagttgcttaagtcagaattaggaacccacaattgccaagcccctccttccttctccttttcccccatgcaatcaatcatcaagtgaagtattcccaattatacttatttaatgttcattaactccataatcctctccaccaccagtcagtaccttatttgggggcctcactcatcttgtttaaattatagaggggtcccatgatcctgtagttccctagagcattcctccatcttcagagccagggtggagaattgatttggatcttagctctgtcagtttctaattctgtggatatattcatttgttaactcaagagaatattacaataaacaatttcgacaatgctgtgaacatacttaccatcatgactggcataagctccacaaatgtttaacaaatttaagttacatctagacctcactgtggaatgcagattcgtgtggttgttgagcacttgaaatgtggcttttccaaattgagattcattttaagattaaaatgtataccagatctcaaagacttcttgtgaaattaatgaaggttttcattgactacatgttaaaataaccgtggttgtatacattgggctaaataaaatatactattaaaattaactttctttcttttttacttttttaatgcagatgctagaaaacttaaaatgacctatgtggtttacattggacagtgctaagctagagggtgtcatttaactttttctttcttttattccctccccttgcaaataggtaccaaattacatatatatctgtcaaaatgatgtaggacctaaagtctctctgtaagttgatccttttgaccccatgattaggagcttcacaatgtggtaccacacctggaaacctccagaacaagatctcaaggaaacacaggaaattcctgaaacagcaaaaccccctatgtgaagacgtctgttattcctttgtgtatcaggagcatcactgttaattaactgttgatacacttaaaacagcttggttggcaatgtcctttttgaataaagaagagccaggtgtgtttttcaggatgaactagacaatgctgtcacaagtttacctctacatcttattgccttggaaaaatttcctgcatatcgtggcacaagatggttggctctccaggcagcagttggcgttgtgaatcagtcatctcagcatgtgtctccaagatcccacagcagggggaaaaagaggtggagggtcacatgcctggtgttacatactttgaggcagaggtggtaggtgccatttctgctcacagctcatggaccagaacaaagccatgcatacctgagagaggaccagaaaatattctgaagcagatggctatttggtgagcagtaaatgtttc

SEQ ID NO: 202 - DNA, 276634 bp, Homo sapiens
aatcacagtcaaaatacacccagatgctctcacacacccagacgcgcgcgcatccccgggccatggggcgcacgtgagcccgcaccccgcgcacccagccctgcctctcgccagagcatcctcagcagctgccaccgaagcagcctcctccttctctcttcctcctcctcctaccacggccgccgccaccaccgctgcggctgtgatctcctatcccctctggtcctccttcctcccccagttcctgctcctcctcccatcccctgctcctcctgcccagcagcgaagggcagaaccctcggctgccgccctccttcgctctgaccaagaagaggctggaacaggtctgtgcagggggggcgctttgttgcgggctgctggagctcttgtggctccaacagccactgggagggcacggggcgggagggatggtagattatttcccagttttcagtcttgctgtatgaatagatgcagggcgaaaggctgggaaggcagctggttccctttgccagttcgccttcctttttggttcatggcgagagagcactgaagctgcccggactcctgcccccgcccacccctaaagctctctttctttgcgtccccactccctgcatccacttccccaggctgagctttctcttgttcagggagctcagggatgggggcggggagagatggatggagatgatccagccgggcacctgggtgcctggggctttgttacatacaacaaaaccagtcctcctcagcttccagctccaggctaggctgcggtccgccggcaatgtggggtgtgggtcgggccgactagggaagtgagagaatgtgagaggacactccctgtatgtgactacacacaggaatgcagtggtgtgtgtcgtggagatggtgtgggttttgtgtggaattcagtgagtgcgagttggagtggtgtgtgtgtgtgtgtgtgtgcgtgtgtgtgtgtctgcgccatggggctgggctactcttggcattacatgtccttgggtctcattccatgccaagccagactgcagcaacacgcaggtggatcaggtccaacctgttctgcccacattggaaggataatgattgttttcaaagtgatggaaatccccccagctgggactgttgcttaggactttctggatgcggaatttcgagccaggttgaccaagccctaccagatagcgttattgttctcccaaagatgcccaactttcttagcagggtttcctctctcagccaatgaggatccaaagctcttacagtgatccctgcagtgccttcccacacccattttaattagcgcatcctaatgtcttcaggtcttacttactacagtgaagttagtggtgtgctaggatgtagttctatgtttgaactaaaaagaacaaactaaatgcacctatgtgttagtcatgaatttgatatagaggttttttttttctttcttgaatgataaggtatgaactggtatggccactttttaatcaaagaaagaagaggtcaataaaaatgaacaaaactgctaaaccttctctttgacatttttatttgtggttttaataaagcattgtttttcagggtccaaaaatatacagttaaaggtagtgattaatcaaacagcagacattttttgcatacctgctatgtgttattaatgttaagtattgaaagtatataaatgaataaaacatcatctcagctcacagggagtgcacaatctggtaggcaagatagagcgtgtaaacagacaattagagtaaagtatgacaaggggcaggcagggtattgtgggagcccaagggaggtatgcttgattggggatgggggttatgatcaagaaaggcttcatgggcgaggtgacatttgagttgagtcttgaagaattaattcaccaggttactaagtggaaaatggtatcctaagttgaaagaatggcatgtatgaaggtagagaggtcatagttaagtgagactgcagggagtccttggaagtgtgactgccaaattctcaacaaactcagaatgggtctttctggtttggagtgatgactggtggccaaaaaaaaaagccagtattgcagattgataaagaccacaacacatctctatattaagaaacatctggctcatttattaatattagtgtgttttgctttaagcaaatctgatatatgtaaatgtgagattccaaggcaaatgaactaaatggacaatatttacattgcagaatttgctgctttacaaaaggattcataatcagattatgttaattaacactgcctctctgacctttacagtgaatttcttttaaccaaaaatccactaacggaatttttccaatagtccatgaatggataaagacaggcatacctgcattacatttactttttgcacaaaaatttaccaacttcaacgcaggaatttcctctcattctgtggatgtttaataaatactaaaagaaaatatgaaaatgctagtaatgaatattaaatccattggctgtgatcttttatcattcaaactgtatataaaatagaaactaacctgaacgggatcttgaggaatttttacattttaggtacttttagtagtttcactggtaattaacaatggtacaagatttctgtgctgtatgttagttttaaaatggatatataataactgctctaatgctcgtgcaattaagccagaacaggggcacattctgagtctcctgttttgttgtgttggtgctgattgcattcataggctgataaatggccctgggagtgagactaagagactgattatttctactggaaatgcctggtggtcacaaaattatgctaggtaagagtgtgggttctgagaacatggatcagcacccatctggagcacctctccccttaaatgaagaccaaaaatagccctgggttctatttgaaaggaatgacagaagtagatgagcttgaatgacttctttcctcgtctggacaataccttgctgtggaggagttgatggcctagggtactttgggcacataaaggtcctttgttcactggctgtcaataccagaaggtatcaggcagtatctctaagatacattctccaaagcttgggctggaatggaatcgatctgtcagctgtgttgatgttcagatctgtctagttactagacagtgttttttgatgtaggttctaaagaagactagttccatagaatgttagtagggcacacctctccccatccacacacacacacaaacacacagggttttgtggtcaagttaagttttggaaattcttacttaaacataaacaggtttctttcctgcagggcttctaaaagtctttactaggctaatgaatattgtgactctccaggagtataaaatatgcagcatttctcagatggaattacccatagagcatggtgttccaacaagcatttgggtctactggtgttgagagacacgttctttgggtaaaagcattctctgctgagttctgagttcagaggctgtcggcatcttgctgggtaagcttggatgactcgctttacccctccaggctttccttccttcccccctctttaaaatgaggttgataataatcatcactctcactgactgtgatggtgtgatgacaactaagataatatctctgtaagtattttgagctgcttagaagaaaggctgtatgtaaactcaaggttattattaaagtgaagtgaagaattaaggcaattatcctgataatgcaggcccaaattctgtctttctgctgaattattgggcagactgcctcatttctctgctctgctttgactgcagagacctatcctcattcaaccttggctgactcagttctctgggtttatttcctttcatattctgaaaatttcagcatggcctttaatatcctggtccagaggtatcatcagtacagccttcagaaaaagtccatcaatctgaacatacactgctgactagagaaccctggagttaggaattaagtttagttggaaagttgcttttatccttcagactaattgtctttcagaagcatttgtaaagggccatgttggaagctagctggtgcaggatttctctccagtagccccaacacccaacctgggctggagtcctgtttacaggagacgcttcttgaacaacagtttcaggggtccattttgtcaatgggaagctgaggccatctttaaggaaatttaaagataaaggaaatagcattcatgtgactattgacccttcttggatcccttgactgctattaattcccagaacctttttttctttacaaactgccttgaaaggagaatggagttcttgagacttaatggctgataatcattgcaaactgggtttggggtagagactgttgcacaaggcattcagtctctaccccaaaatgaacgtcaagacattcgggttgctggttctagagtactctatactcagattagctcttctctgcatgaaagcagcaagcttcagttgtaataggaaggatttctgttagccacaagagataactgtgtgactttaagactgtgtgatgctgtaaagccagagtgaagttattcgctgttctggagtacatagtggagatgcttgttcagtgggggacattcatagaatggtagagctacaaatgcctatggaagtttctctgttgtaaaccttatgtttggatgatgaaaatgaggatggaagaagtgaagtgagttgtccaaggtcacacagctaccacatgacagaacagaagtcattctaagagttgaaactcagatctgctgcctcccagtgttcttctctttgacttaactgccttcttgtgtagttcaggggagtgaggattggctcatttggtgggacttggaggtcatgtccagttctgagcagtgtgggctctcacattgcagttttagcagagggataggtttctagtggagacctaaaagaccatgcttctctctctccctcctcattcctcttgagtgtatagttgtctgattcaccaagccaagcacccagttggtaacctgaggactagatattctacctgagattcatggtggatgatttgatcatcctagtccttttactttggtgattgattaataaccattttctgtgtgccaaggatccccttgaaagtcatgaaagctactgatgcactccccagagaaggcctctcatccatggacatgtgcatgtaatttcaaagcattgtaggtcgagagctcttgctctgcttgctgttggtattggtacacagcctagggtgactggtagaagctccctaaatatgaaagattcccagaggtggaattgtcaatcttaactcggagggaaatggaaatgctgggatgagctttgtgccaaatagacaggggacagggagtagagtggaatttcttatggataaaagaatggaattggatcctgaattcgagataaaaatagaaaaggaattgaagtgagctaaccatgtccccttccttcaaccttatgaaagaaagtgaagtggggaagctaggcaggtgggaaatttgggaggactggggagggggtcagtccagaaaggatggcaatcatgccatatttaaatgaaataaaaattcttcccaaagaatgagacaactctttcacttctctccagatttcttaccctagtcaaacacctaaataccaaaagctcagggctttgggtattagaagttgtcttagattctggaacactgtctccttgaaaaggacacatttaaaggctgggagtgggggctggacattgtgggggagtggcacagcatggctctcttcttgtttacaaaagcatttttattatcaaagaacacatgctcattcttgcttataaaaatagagatatgatgtagaatgttccttccttgtctctccaacactgatcccccaccatgttcacaggttggtatgtatcacattgtgcatgtttttatgaatattcacataaatacattcatgtacataaaataatcaaagatgtgaccatgtgctgttctacagaatgctttttactgaactatatgtctgaagatcttttattgccagtagacatctagttatttcattcttgtttttaaattttactttaagttctgggatacatgtgcagaatgtgcaggtttgttacataggtatacatgtgccatggcggtttgctgcacctatcaacccatcatctaggttttaagccccgcatgcattagggatttgtcctaatgctctccctctccttgtcccccaacccgtgataggctccagtgtgtgatgttccgctccctgtgtattttattcttataaataactgcatagtattctattatataattgtaatataatctctttaatccaacctttgttgatgaatttttgcattatttctgattatttttacattattaaatattggtgcaatgtaccttcttgtacatacaactctgcataccactgtgagcaattttgtcatataaatttaaagtagtaaagttgctggtttggagtttgatttgcacatctttgattttaatagagcctgccaaactgcctctcagaaaggctatcacaatttaccttcccatcaacagtggccatttctccacactcttcctcatcaatttcagatattattgatctttttaatcttagacaatgtgaaggctgaaaaaaaatctcctttctctttgcatttcattgagtactagtgaggttgaacatcttttcatgtgtttttttggccatctgtatttcttctgtgttgccatttcatatcccttgcctgtttttcttttgagttgttctttctgcttctgataactgggttctccttcttttgagttgttctttctgcttctgataatgaggatctctaaatattttggatagtaaccatttaactcttctctatgttgcaaatatattaagcagtttatcgtttgtcttttaactttgatttggatgtctttcactgtacagaaatgtttatgatttttgtaaaaatcacaattttcaatctattcctttataagccaacaatgccacaattagatatccttgcactatgtcatatacagttggctcattatttccttaagataaattcctaggattagatttgttcagttaatatttttctcgatattgccaaattgctttctaaaatatttctagcaagttacactccaactacagtgtatacaagtacattttccccctcctcctgacgtcttctgataattcaggttttggctcttaaatcaaatgctaggctgaaattcatatttgactgggaggaaaggcaagactgagaaaggctgggagcagaaatccctaactgcacgtggaacacctgtaatacatgtttcaccttcaattatttaagtaaacatgctctttaattcatttccaactagaactgtgtcgaaagcgttttccaacgttaaatcactctaaattcactgtgaaatgaatgaccatttagggtcatctctgctggcagcatctgcaacagcaggcaatgatgaactaactttagagctctatctcatcttaagacacttggaaaaaatctactgctgcatcttcactgatctctgaggtcagctagattggttccataactttctgaaggctgagtggtgagtaggaatcagtttctatttaacttggcttcctgcaaagaggacaagtttgaggtcctcccatgagaagttattctaacagaaataaacagtgatgtcacactctgcaaagggtatagtgccaaacaagtacaggtgtagctttttcccttactctgcctgggcttgcttcatcttcttgtgcctgttttctgccagtatccagatatggtcaagggtattttggtgtgtgctttaggccaaaggtagggtctgtggattagaagatggaagtctgagtggtagtttatgtagcttacgaatatcttttgtctgaagagcacagtagcaacctaaaatcctttggaggtggcagggcaatggggaaacatgaaaaagtggtgatgatagttgttgcttacccattttacagatggagaacacatctggaaaggagaaatgctccaagagttggacactgctggaaaaggatcctggcatacctcctaatacttgctaactaaagatttggcaacttctctcctctagggatatatgtatgtgcctttaaagtgaagcttcctgatttgatatgtttaataatgccctttgtacttacccatcattcactttatctagtgtggtactgacacagcccaccccagggacgattttgagctgtcagaagatgggtggattattgtccccaaaggaataatttggattacttgaactattgacaattatgagttgtggttttccacttacctcaaaatcttggtatttggcaaatgactttagattgtatctaatatttgtctttttttctcctttttaaagatttggactagagtaagcatagttcacagaggaaatgatggccagataatataattattaaattttgctgccttgaaaaaagtggttttagtttttatgctaatgaatgtcctgttttaaaactagtgtttctctttttaattgccaaataatttaaaattgaaacatcatagccacagatatggattctatgcataaatcatatgatacatttatactttttgatggttacaagtggaaaggtcatctttctttttaaaactatgcttggtgctttaagtagaattggaaattgtcatgtttttcttttctaatgaactattctgcaaaggtaacattgtttttttaactctgattagaactggaaggggatgtctgactccatacttaatccaaaaataaaaacctcattaacaaagaggcaaagagagtcagtaaatggagcttacattaaattgggaggcagaagtccagggttcgagttctggttttgttattaattagttgtgtgaccctgaactagagcttaaatgcctctgagcctcagattcctgacatataaaatgagggcatcgttaggaattgatgatccatattgtaattccttcaacttaaacaaggcattctcctctccaaagtcaatgtttgctttgtgacagaatcacttggggacattttaaaaatatattttgaaggccccacctcaaccagttgaatctgaactccaagggtagacccaggaaacctatttgttaactagcttcttaggtgatttgggagaagactggaacaccctccagaggtaactttcaggaggcaagatctcctggtgttttctggcttgagggaatgaaagcattttcaaaagtggggaagtccaggtcacctaggagctctggcttagaaatctatgatatgaaactgcacttgaggaggctggcttttggcctagctccctgggactggtttctgcagaggtgaatggagagcacagtgttcttcttaagaagagcgagtttggacgaacaaactgaccagtcatttaataatgagtatatttcaagccctttggcacactaccttgagaagaagcattactgagagagggcacagtgatttccataactcctagactgttttggcccaagctttcctttgaatcctatttcaaatttctattccctctttgactttttcaacttttgttcttcttcccttcattaaattcacagtgttgcagtgggtttttcccacttccccttgatctcactgatcttatttccttcagccataggcactctctcaataccatcctatcttctaaatgccaaaaagaaaggagtcagcactagtgtacaccaatttgccccactatttccttctgcgccaactttcagcccttcacttcattatgggagtagttggagctagggaaatgcttctctaaggcaaactttcagagacagcaagtgtttctttttatatatagctcccatttattaactgtttgttgtgtgtcaggtattgcactgctctttgcatgtgttgtctcatttaattttctctgcaactctgttaggttaatactgttagcattccattttacagaggagggaactaaggctcagagcagctaagtgatttgcacaagttcactcagatggtgagcagcaaagtgaatctctgtctggtcttggggtctgaatggttaaacagagtgttctactattaagggcttcctgtggtaataagactgtgttacaccaaaggggaatgtatgaagcaacagatcttcttgggtgtgaccagtctgagccttgaagcaacaataaagaccaggaaagaaaggggaggttcattttaatggcagcaaaatgttgccagaattattgtgtgtcattgtaggggtggggctcagagattagtcttgattcttgtgaattgttaactgagtaaatctctaaatattatcattgagagataaattcctgatatccccatgactattgtttgtgtcacaaatcatgggaatgtggaacatactttttgttttcctcctcctactcccagcaggagactagtgccaagggtatagaggacctctgggaggcagggagtgacttcctggatgttttcagctaaagggagcctgggtgggggaagacaaccagggagaggacccagaataacatgaataacagtgtcattggctgggattattgggtttccagctcactcaagttcttcctgtctgattctcattatcaaacttgcagcatgcagcaaaggatatttggcatccagcaatacagactcattgatctacgactgatacgattcaaactcatgaacataaccaaagcatgcactgcaatttccagactatacgtatgggaccaaatccatccttaaaccctaacctaatgccctttttgaagtagccgaacttttcactttgactgtagtatagggcattgagcaatttaacatcactgcacaaaaacagaccatttgttttctttcccgcagctctttcctagaaagatcttctactggctataatttctctaaaaattcccttccaattggagccctcaggggaggacttgcacccatttcctgcaatatctgtcctctttattgccgtttccggtaatgagagtcaataggcatcaagaaaccaaagatgagccaggcatgggggtgtgcacctgtagtgcacctcagctactagggaggctgaggtgggaggatcacttaagcccacgagtttgaggctgcagtgagctgtgattgtgccactaccctccagcctgggcaaaagagtgagaccctgtctcttgataaaacaggaaagaaagggagaaaccaagaaactacggtcttgtaaggcctcaattgcttactccatgtctaatgccagataagtcactttgcctctttaggcctcagttcttccatctgcaatgattctaattctcccttctctgtggaaaacttggagcaatcagatcactgaaaacagactactttgaaagaaaagtggtccaagatatatgactgtgaatgtcttcatgttttccctggcaaaagagctgttttggagcaaaaaagagggtagggtaaaggttaaaagatcacttgcttaagtttaagtccctgctctgccttctgctagctgtgtggtcttggaaagtttcttaaccacctaactgccttggctctgtaaaatggaaaaaataatattagtacttacctcacagagttgtggtgaggaatcaaagagataatctatgtctgtccaatagatagtgtttatttatggcaactatttttattttgaatgcatgaagctccatgaagaggtttggatcctggctcaggcactttggacagtcatttagcctctctaaacctctgtttcttcacttgtgtaatggggataataatagtagctacgtttttgggtttcttgaggaatatataagataattcctgcaaagttctcagtacaccacctggtacacagacgtgctcaataagctattgctattatcattcggttgccatcctcagaggacttgtggatcccttggtccctgcttttctatatctggaccacctatgggcctggctcccaccccagaaaatatttctggtgcctgtgatgtactattatcctcatttacccttgtttgggttaagtagaggagatagcctttttgcataggggaggccccaagactgaggggacttcttgctaaagcactgcacaagggctgcttgtggagaacagctgattccttgacctcgaaaatgtttcacacagtgaccaaaatgggaacaaagcagaccctgctttacgactcccactggagcctggtcccatgaagcacaaagttctgtcattgccctccccacgcctcccctgtcggctccaccagccatatattcccttctgacattcctccaagacaactggtcagagagcacttagtctcctccccacataatatgttgagtaaggcaaccagatgctgccatagtgacaattcctacctgatcaatagagctgggaattaagccctggtgacaggaccttctttgtggagggcctcctcccagggcatcgcctagctcagcctggtgatgaagcaacctgccctacccaccactgtctgtgtactaatctctgggcctttctctatacattaatccacatctctggggccccaaagtgaccatttcagagaaattttgacctcattggattccccaatgtttctgccttggttcagaccttcatgatttcttgcctgaactatatcatattattgttcctgctacttttacttctatgaataacaataaattatagctaacagttattgtgtacttattatgtcctagttgctgtgctagcatttgcatgtattatctcatttaatagtcacaaaaaccctatgaggcaggcactattatccccattttacagaggagcaattataataccagctaacatatattgagtgcttaccatgtgctaggcactgtgctagctgccttatatatttttttctcatttaatcctcatgataactgtatgaggtaggcattattactactaatagagatatctgtaggcctctggtagtaaaggactggataagaaccctgatacttatgaaatattcagaagggttgcatgacccaagaggactttggatgtacttttacaagtccttcctcactaggtgcttgggtacagtagacattgctcattttgaatcttgcagggaccctggccatggctggtgataggagaaggagtggtgagtctttcttaccctgggttgttttagggatatctgggatcaggctatggtagaggcacaaaaattttcatgccttgctcatggtgttttcctacttggtcttctctaaaaatccttctcagaccatgtcacttctttctttcattcctttagtcattcatcctttcatcccaaggacacatgttgattacctactatatactaggtaatgtgctagacattcggaatattattataagcgaaacagacataaaacctaccctcatgaagcttatggtctaatggaggagacaaacattaaacaaataaactcagacacatataattgtaaattatagtagtgctgtgaaggaaaagtatagggtaggagagacaatagcaggggagacttcattgagatggttgaggagcatgaagaaaggcccttctaggggaaatgacacctaagctgaggcctgaaacgtgaataaatattaacaaagagtgtttcatgcagagagagcaaattgtacagacaccctgaggtgggtactttccatattcaagtgactaaaagagacagtgaaccgggagaaagtgatgctcaatgaggtcggagaccatgcagaaccttgaaggccatggtaatgagttccctttttatgccaagagcagatggaagccaatgaagtagaatcagtgaagtaagggtagaatcagggtaatgtaattcatagttttacaatatcattctggccgctatataaaatggaacttaagagtggcgagaagagaaagaggggcaagctaggaggccatgacagtagtccaggaaaagagatggtggtggcctggactagaggtgacagtggccatgaagaggagggcaaatgcagcatgtgtttcaaaagagcttgctactagactggatataaggactaagaggagagaggaatctaggaagacttccatgtttctagcttgaataacgtgatgaaaggtgtccatttatggacatggggaagtatcctgaagcagattgagttgagctctcatcctgtgccatattcagtctaaaatgctcatttagcatataagctctattaccttgttttgatggtagttaacatgaatgcatttgttctctccctaggtaggttttaagccccttgaggacagtagctgtgtcttactcatctctatattccccaaggcacccaagatatgatgtattaaatgctgtatgattgattaacaaagggaagaggttcctttctctttcaaccttactcttcttgccaaggcatgggacattactctggattatgcttttttaaaaaaacaaatgtgacgcactcaatgatatatattatttgatatagactttgaacttcattcaatcattaatcaccttttgaataactcctgccatatgagcaagatacataaggcacacatacgtttgctctgcagaatacccttcagcagtgcagtacaggctatggagtcacagaagaatggtctcacgggaatgtgtgggctaggtcaggattggcagagcagaagactagaagtagcctaaaagcctgagttgtttaggcagttagttttaactctggaacaacttcactccaatgatttcctcccaaaagggtctattcagagtttcgagacatcttaattccccataatgcctctccatttctgcaatccactgccactaccccaaatgtaagttcctttcctctcctagggattttcatcctcatacatgtttctgctttctctttacactctatcctctttctcgggctttccgtctgtatcctttgagatctatgttgcatatcaacaaactcctctggtccttcaccctcgtgtacatcacagtgctggctacatgttagcatcacctggggagttttttaacgggtactgaagcctggaccccatccctagagaatctgattcatttggcctgaagagggacctgggtttccgtactttttagagctactccaggtgatactagtgtgctgtcaggttttcacaccactggtacctgcttgccttaattgacacatcagttctcttgcagcttatcaagtgtaagccgctcattctcctgggttgcacattctacagagctgaggggtgatagccacactctcctatttccccagaactatttttaggccttttaagttcatcctgaaaaagaagcgaaaaaagccaacagataacaaaattaaatgcaaactaaattcattgttttttttaaaaaataaattgattttaaaataaaagaaaataaaatgacatcaatgctccctgtaagtgtcatggcatctatactgctcactcttttcttttgtcaactcttgtcttcctcatgtacccacacttttcctaaatgtttaatacttggtttatcagtttcctctccaacctaagtcctgcttttctcctggaggactttagtgcccttgttggcaatctatccaacattctggacttatggttccttcatcactttgacaaatatttatggaatgcctatgtaccaggcactgttgtaagtaagtactaggtatggaacagtgaacatatggacaaaatccctgccctccagaagctcattatcaggaaggtgccagtgagggggataatcaaccaatcagtaggcaaataaatgttaataagcattgtggaaaaatttaagcagaggatgagggaatgctgggagagagggatcaattttaaatataagggaataaatttcaacaagaatagccttcactgagctacccttgcaaatatcttgagggagagcattataaacatagagaacagcaagtgcaaatgtcctgggacaggagtgtacctggctgtgaggaggcaagtctagcttaagctgagttagaaggtgaggtcaaggaggtaacatggagatgggtcttatcaggccttacaggaaattgtaaggacactggctcttactttgaatgagacagtgaaccactggaggggagggttctgggtagggaaaggaatagggtgtgacttttatttgaagtttccttgatatcagttatctccactcactttcatctctactgcactttgataacctgtccccattgccagctcctggattttgtccccaaactgttctacctctgaaatcttaaactctagtattttaattgagagagcttatatatccagctccctcatgctaattatactttctcttttatttcatctaaatctctcatctgttgattctacagtggtcttcgtggatgttagtccctcctggcttccctcttttccctctccctcctaaattccatagtgcatcttttccagcaattctcatgtgtcaatatattttttttcctatttaaccctatattatagtggtttagcaaaacccaaaccatagatcattctagtggatcttgttcctggctgcacatgagaatgacctgggatgcttagaaacatactgatacctgatttcactggtttaggatggggtctggatatagatatcttaatgatccccaagtgattgtaatgagcaaccagattgagaacctgtggactaacccagcatctgcctcttcattttctatatcttgacatctgagcagaaaaccaaatctcaactgctccctgtaaattgcttggaaatcttacaaagtgacgttagtaagctacatgtcacttttctgttatgttaaaccaacctgcaccaccctcctctaggcttcaacctcacttctgtctctgtctctcctagaagatgacttcttttcccatttcataaagaaaatagcagcttctagcaccccaagctcctgcccttctacctcaaacctagatgtacctgtgtccacttttatcctgttgtctcctctggcacttccaaaactttcctcattcttgtagatcttcaacatcttgccactgggtcttttcaaaatatctacaatctcttttgtctttaaaaaccttctcttcacctctagattctcacttgctagctactgccctatgtctcttcttcccttcacagctaagcttcttgaaaaaaggagtctttaaccaatcccattctctcaccttccattcacttttttagtcccctggaatttggtttctggtttcatgaaacacattttgctgtggacaccagtgatttcccaagtgacaaatctaatgaatagttctgtctttttctttacttgttgtttctgagtcattaattttatactgcctgtcttcctgaaaatctgttctttcatggattccatgagagtattttcttgatttacctcctacttctttggcagcttcttgagttcttcttccttgtcctagacctgaaatatgagtttggaaaaatatgaggaatctcttcttactagttcacatttctttctcagcaattttatgcatgcctttggcttcaagtatcacctacatgttcatgactcccagatatattacccccactatggatttctctcctgatccctagatctgtttatcagactgcctatggactgcctctgcctagaaattctgcaggaacctcaaagcagtgtgtcccaaacttaacttggccttttagaaatactctgactccaccaaaccagaaagcggagtcatccaagattcctccttcatctccctcaccttccacaattaccaatcctcccaaggctatctctaaaatctttgttatctatttgcttcttgcatcttgactgccacatctctagattctcatcatctctcctctggaccactacaatatcttcctaactggatttcttggcattataacagcctccttcaagctgtcttgcaaagttgaataatctttccaccatgcaaaccttacttgttatttctctgctcctatgcaattaatcattaatgactcccagggacttatagcagtggttttcaagttatacttcatgcatccctgtgtgtgttctggagtgaagttgggggcagcaggccgagcaggccacataacagggccaagccgccaagcctctaatttaactaggacagctgtgctttatatctgtttatcatcctggcctctgaagatatttcccattagagtgaaaattctacagccaaaagaaatatttgaatgctattgatgttgaccttcataactaataagcttagtatttatcaggaacagaagggtatctctgacatcaagaatgtgaaagcttcataggccttgtgtccaggaactttatcccccctagatgtattcgtttggttgcaaggcccagaatgaggcctctcacagcttgatgtgaccttttgtgtgttgtaaggccctttctctgtctttcagggctgctggtgcctgttatacacatgaaatacagaactctgcctgaagaacaaccatggccttgatgcaggcactatccctggtcagcatcagatatgaaattgcacatagttctataatttgcattttctacttaatatatgtctaatatactcctgagtgattgtagagcctatttaaaagcagcagaatattccactgaattaaaattttttacatgtttacttcatgaaatgaaattctgttgcctttatcagaactgggagaaccttaagacatcctgtccagtcctcatgctgtggtctccatgggaactaattcccagtgagctctttgttctcagggcagcttagttgccctcatttactcttccaaactgtgattaagctcaggctgtaggcttttcatctgcatccaggaaaagggaaagtgcacactcttacctataaaaagggaaatttgccattgataaatctggtggttcccaggcccatgctataaaattgcctcaatttttccagttcagagaatgttcatggtgagtggagcctatggccatggccaggcttgactgacctaagcctctagtgtcatctctccctaaacaaatattcttattaaaactgctgttaagtaaaagcactgaattgaaaattaggttttcatcaggttctagtgctgattgtgccactcaactaactgtatgaccttgggcaagtcactgaacaattctcatttgaacacagaaaggacgatgttgaaccaagtgatctctaggattattttcagttctgataccttgagtctttgatactaggagataattgctatgtaaatgctttcaaaagttcaaagtgctatatcagcgtgaggtgttatgattaattaaacttactgctttaagttcccacagagcataaggagaagtaaaggagccttcctgatacacaactgggcaagtcaacatccgaatcatctgaagttagcatggtagtgttatttactgggaagaaaaataataataagagttattattcattgaaacatgaccacatgccaaacagcatgctagtcactgtcacatacatttttattattcatccccacaatgaatccattgttactattatttttgcccttttacaaatgagaaaactgagttcaaggaggttaagtgacttgattgccatcatacccctagcaatcgatgaagctaaggtttgaaccacaatttttctgattcaaaagctcaagcattttcaagtgtgagaaaatgtgagatccaaggccatgttttctatcccagtacatctaaaactctaattcgtgtatgaatcaccaggagttcttgctaaattcaaattgctgactccataggtctggggtggagcctgagcttctgcatttctaacaagcttccagttgctgcttgatgtagcaggtccatggaccacactttgagtagcaagagactagagacctttatatggaaatcatctggcctatatttgcccctggagcagggctgcacagactgcactgcacaactccagggagcactgttcacattgcagtctctgtgcagtgtgcctcttgagttgtgtactgtgctccccttgtcctagaatgagaacattgtgagtagtgagtagatctacagaatcttcctctacctgtgccacgtctgaagaacaggaagtgttctttccctcacaaatgaaaaatggatcaatgctgttgagaaaagcaacacaaatccagtctgcccacaatgagggtggcccatttggtgttctaaggcaagatggggaggagggggagaaggaagctagctggcaagctggctggctggctgactgactgactggctggcttgctggctggctggctggctggttggcgtggcaggctccattcttatgctaacaaagctctgattccaggcagcagctgctgcttgtgtgggtgcttgggccattcatagcagcttgctttaccagtgccagacccccagaacaggtgcggccgcacttgttattttgctcagtcctgaccgtccagacagggagctgattatcactatgaatctgggattgctgctgatattccagcttctcctgaacaaaggggccagccttgagacagctgtcttttctggccacagtgaggctgactgccctgaaggccatgtgggccttggggaggtgggtttgcattgcaaatgggacggagaaaatcagacccaggtaagcagttcttctgaaacagttcaaagtgtctgagagtcagaaagtttgggggcttaagcccacagtccccaagcaggagctccaaacctattgagatctctccaagctcctcttctctggtcaggtgctgttgcccttagccttcccttggcctaaggtctgctgcagtggccaagggcaagagaagggcagctggctgacattgtccccttcctcctttgctcagcctcaggaccaggctttgggaaccaggaaattagcttctattcacaaaaaggatggagaactatagcactgtggttaagaagaccagctccagggtgaggcagcctgatacagatcttaacttgattactcactagcagcaagcatgagcttaggcaatcatttgatttattcaagcttcagttttgtcacttctcatagaagaataacaatagtacttccctcagggactattatgaggatttattattaataataatgaaagctaacactgacagagcacctactgtggactaggtactcttctaagtactttacacactgtaattcactaaatcctcaaaatgatcctgtgagagggacttgtattatccccattttatagatgtggaagctgaggatcaaaggggttaagtaattcgcccaacgtcacaaatctggtgagcagcagagctgagaattgaacctagcagtttgctccagaggccacgtcgtatgcactatgctttactgcacaaacttaaagtggagtgagcacagtgcctggcacacataaatccttgctaaatgagggtggttatgattcactaaactgatttagcctcactgtttcaatgaatagctaaatatgtgtcacctaaaaaagaaatgtatatttttttcaataagaatatgggtttccacagctggagtcttcataatggaaagagtaatagtctttcttggccccagggctccagttccattcattcatacacaaaggagggtaggacaattcattttcccacttggcttagcagaccatttttgattcccagagcagcttttcatctctgcccaccaaaccacctcctcttaattctaccgcctctacaggcccactgcttccccataacctttagccctgtgaatttgattcacttattatgtgaaagaaagggagggactcaaaaaaggagggagggagggtaggagagaaagaaaggagagagagtgagagatcaagaacagagagagagagagagatcaggggtgggaaggagatacttctaaaaagaaaacaaggaagaaaaaatagtcaagacagtcctattcaaatctaatcttaaataaattttgactgcagttttagaagaatgtttattgaaaagggaatatgtccataatatacaattatgtgagaaaagcaggctgcaaaatagtgttacaccattttgaagtgtgtatgtacaaatataaaaaaaaaagactggaaggaagtattccaaaatgttaacagtaatcatctgtaggtagtcaagttgtagattatttttcttctttaaattttctgtaatttttccagaattctaatgaatataaatgctttttgtaattttaacaagatctaaggaaaaggaaaaagcagggataggatatgtcggtactgcctgcatgagggatggatcctgcccccaagaatgccctgtactagacagaaatgattgttgtcctatgtgtattgcaaaattgcattttctgtgtgcaagggaatgctagattactcaacaagaccacagagagctttgaggcacatgctcagctcccagtcagctctgagagtgtctgatcttcctgcccagacaaaccctgacctgtggtgtgtccacttagaataccatgtgtccctgactacagtttgggaacccagtggtagagttaacattctacagacttgccataggggcaaaaaccagaacagggccaaggggacaaaagcaaacagatcagggactacgagtgcagaaggtcagagctgacaacaggaaacagaaggatagtatcttcagtgagctggagggggttagtgctgaggtgtcacgtgcaagattcttgttttgggtatggctgtgttggagacgggtaaaaagagtgtaagtaggcacagggttagggacaaaggcataactaggggccacaaactcaaatgcctttggggaccagactggtagcttaatgattgcaggggcctgggtgaggactgtgctgagctgaaagagaacgattcccatggaagagagcagtgggaagcctgggaatttgggcccacatttacatgtcttatgaatttttaagagaagatagatatccaggtatttatgtaaaatctcttaacaattaatttttttttcaatgtcaagacactacgggccaagcaaaatatatctgtgagccacacatttaaaaacatttcacttttaaataattatagattcacaggaagttgccaaggtgttacaaaggggtctctgtgtacctttcacccagttttcccaatggttacatctacataaccatcatgtaatatcaaaccaggacaatgacattggcacaatgtgtgtgtctagttccatgtcagttcatctcatgtgtgggtttgtgtgtccaacaacacagtcaagatacagaactgttctaccattgcatagatctccctcgtcacatactagtcacatccattttcctccctccaacattccttacccttggcaaccactaatctattcttcatctctatagttttgtcatttcaagagtatgacacaagtgaaacaatatattatgtgactttttgagactagctatttttactcagcataatgccctggagatccacccaggttgttgcatatactagtagttcattcctttttattgctgcatagcatttcatggtatggatataccagagtttgtctaaccattcaccaattgcaggacatttttgctgcttccagttttgggctttacaaatacaactgccatgaacaatcatgtacaggtctttgtgtggacaaaagctttcatctctagaataagtgtccaggagtctgattgctgggtcataaggtaagtgcatatttagttttataagaaactggtgaactgttttccagagtggctataccattttacattttcaggaacaatgtatcagtgatccaatttctctacatctttgccaacatttggtactgtcacaaattttttacttcaaccaatctgacaagtgttagtgatatcttgtggttttaatttgcattttcttaatggctaatgatattaaacatctcttcatgtgcttatttgccatatatataaactcctcagtgaaatgctggttcatgtcttttgttcattttctaattaaattttgtggtttttgtcattgagtttgagtttttaaaaatatattccagatagcagtcctttgttagatgcatgatttgcaaatatatatattttttcagtcttcagcttttcttttcattctgttaacagggtctttcatggagtaaagtttttaaatttttatgatgtctgatttattcatttttctttcatggattatacttttcgtgtcatgcctaagaactccttaccagccctgggtttctaagatttttcccttatgttttcttctaaaagtttatagttttatgctttacatgtaaatctatgatctatgttgagttaattttgtgtgaggtatgagagcccgggtttaagtgattctcgtgcctcagcctcctgagtagctgggattaaaggcatgtgctaccagacctgcctaatttttttttttttttttttttttttgtatttttagtagagacagggtttcacaatgttggccaggctggtctcaaactcccgacctcaggtgatctgcccacattgaggtatgagatttaggtcaaggttcattattttgcctagggatgttcaattgctacagcattacttgtcaaaaaggcaattcttccactgactttttttttttaatagagtctcactctgtcatccaggctggagtgcaatggcgcgatctcagctcactgcaacttctaccgcccgggtttaagcgattcttgtgcttcagccccctgagtagctgggattacaggcgtgtgctaccagacgtggctaattttttttttttttttttttttggatttttagtagagatagggtttcaccatgttggccaggctggtctcaaacttccgacctcaggtgatctgcccacattggcctcccaaagtgctgggattacaggcatgaaccactgcacccagcccttccactgaattctttttgcacctttgtcaaaaatcaggtgggcatatttgtgtgagtctatttctgagttgtctattgtgttccattgacctgtgtgtctatccttccaccaatacaatgctctcttgattactgtagttttgtggtaaaccttaatattgggtaaaacaattactcttgcttgattcttatttttagaaattgttttagctatgctaggtctttccaaatatattacagaattatattgtctatagccaaaaatcttgctgggatttctataggaatagtatgaaatgtgtatgtcaattttggaagaattgacacttttactatattgagttttctaatccatgggatctatccatttatctaggtctttgatttctttcatcattgtctttacatttcaacatacaagtcctgtatagattttgttacatttacacctaaataactcatttcttgagtgattataagtgctcttgtatttttaattttggttttcacatgttcattactagcatatagaaatacatgtatctaatgactagtgatgatgagctttttttcagatgtttgttggccacataaatatcttcctttgagaagtgtctgttaatatccttcacccacgttttgatggggttgtttgtttttttcttgtaaatttgtttaagttccttgtagattctagatattagacttttgtcatatggatagattacaaaaattttctcccattctgtaggttaggttgcctgttcatctgatgttagtttctttggctgaacagaagctctttagtgtagccataaaaaagaatgagttcatgtcctttgcagggacctggaggaaactggaaaccatcatcctcagcaaactaacagagaaacagaaaaccaaacaccgcatgttctcactcataagtgggagttgaacaataagaacacatggacatcgggaggggaacatcacacaccagggcctgctgtgggtggggggaaagaggagggagagcattaggaaaaatacctaatgcatgtggggcttaaaacctagatgacagtttgaaaggtgcagcaaaccaccatggcacatgtatacttatgtaaaaaacctgtacgttctgcaaatgtatcccagaacttaaagtaaaataaaataagtacaattggtttttgtatgatgatattgtatcctgcaaaccaaaacttcattgctagatcaaggctcatttttataaattcgttgacatattattctgtgtagatgatcatgccatctgtaaatagagacaattttattctttccttttggatgtataagacttttattccctttcttgtcttattgcactgggtagtactacctcgaatagcagtgatgagagtagaaatcagtgcttcattcccaatcttagagaaaaacattcagtctttcaccattgtgatgttaggtttagctttagtttttaaaaatcagcttgagataagattcacatgctgtacaattcacccatttaaagtacaagattaaagactttgagtatattcacagaattttgcattcatcaccagaatcaattttattcagtgctctcaaaataaaccacataccccttagctgtcaccacccaatccaccatcttccccggccataaacaaccactagtctccagttggtctctatagatttttctattcaggacatttcatataaatgcagtaatacaatatgtggccttttgtgactggcttctttcacttagcataatgttttcaaggttcatccatgttgaagcatgtattagtatttcagttatttttattgctgaataatattgcattgtatgcacataccataatttgtttatccattcatcagttgaatatttaggttgtttccatttgttggctgccataatgtctttttattattgagttacaagagttctttagattctagatacaagtcccttatctcatatatgattttcaaatattttctcccatcctgtgggttgtcctttcattttcttgatgctgtcctttaaagtacaaatgtctttaactttaatgatgtccagtagtttattttttcttttcttgactatgctgttagagtcagatacaaaaactactgcctaattcaagatcactaaaattcacacctatgttttcttctaaaaattttctagttttattttgtacatttacatctttttatccattttgggttaatttttatatggcatgatgtaggagtaaaacttcattattttgtatgtggacatacagttgtcccagcaccattagttgaaaagattattcttttcctaataaaacttcttggcacccttgttgaaaatcaaacggccataagtgtgagagttcatttctagactctcaattctattccattgttctacgtatgtatgtaggtatgtatgtgtatatatacacacatatatatacacacacacacatatatatacatatctatcaatctatctatctatctctctctctatatatgtatgtatgtataagacttttattccctttcctgtcttattgcgctgggtagtactacctcgaatagcagtgatgagagtagaaatcagtgcttcactgcgtttgagctctgagaatggactgactgcctcctcaagtgggtccccgacccccgtgtagcctaaatggggacacctcccagtagggagttggctgcccctctggggagaagcttccagaggaaggatcaggcaggaatattgctgttctgcagcctccgctggagatacccaggcaaagagggtccggagtggatcttcagcgaactccaacagatctgcaactgagggatctgactgttagaaggaaaactaacaaacagaaaggaatagcatcaacatcaacaaaaaggtcatctacaccaaaaccccatctgtaggtcaccaacatcaaagaccaaaggtagataaaaccacaaaatggggagaaaccagagcagaaagggggaaaattctaaaaatcagagtgcctcttctcctgcaaaggtttgcagctcctcgccagcaacggaacaaagctggacatagaatgactttcatgagttgacagaagtaggcttcagaaggttggtaatgacaaacttctccgagccagaggaggatgttcgaacccatcacaaggaagctaaaaaccttgaaaaaagattagacgaatggctaactagaataaacagtgtagagaagacctcaaaggacctgatggagctgaaaatcatggcacaagaacttcgtgacgcatgcacaagcttcaatagccgattcgatcaagtggaagaaagggtatcagtgattgaagatcaaattaatgaaataaagcaagaagaaaaggttagagaaaaaagagtaaaaagaaatgaacaatgcctccaagaaatatggcagtatgtgaaaagaccaaatctaaatttgattggtgtacctgaaagtgatggggtgaatggaaccaagctggaaaacactcttcaggatattatccaggagaacttccccaacctagcaaggcaagccaacattcaaattcaggaaatacagagaacatcacaaagatactcctagagaagagcaaacccaacacacctaattgtcagattcaccaaggttgaaatgaaggaaaaagtgttaagggtagccaaagagaaaggtcgagctacacacaaagggaaacccatcagactaacagcagatctctctgcagaaactctacaagccagaaaagagtgggggccaatattcaatattcttaaagaaaagaatttccaacccagaatttcatatccagccaaactaatcttcctaagtgaaggagaaatgaaatcctttacagacaagcaaatgctgagagattttgtcaccaccaggcctgccttacaagagctcctgaaggaagcactaaacatggaaagaaacaaccagtaccagccactgcaaacacaggccaaattgtaaagaccatcaatgctatgaagaaactgcatcaattaacaggcaaaataaccagcgaacatcataatgacaggatcaaattcacacataccaatattaaccttaaatgtaaatgggctaaatcctccaattaaaagacacagactggcaaattggataaagagtcaagacccatcagtgtgcttattcaggagacccatctcatgtgcaaagatgcacataggctcaaaataaagggatggaggaagatctaccaagcaaatggaaagcaaaaaaaagcaggggttgcaatcctagtctctgataaaccagattttaaaccaacaaacatcaaaagagacaaagaaggacattacataatggtaaagggatcaattcaacaagaagagctaactatcctaaatatatatgcacccaatacaggagcacccagattcataaagcaagtccttagagtcctacaaagggacttagactcccacacaataataatgggagactttaacaccccactgtcaatattagacagatcaatgagacagaaggttaacaaggatatccatggcctgaactcagctctgcaacaagcagacctaatagacatctacagaactctccaccccaaatcaaatagatgcaataaaaaatgataaaagggatatcaccaccgattccacagaaatacaaactacaagagaatactataaacaactctatgcaaataaactagaaaatctagaagaaatggataaattcctggacacatacaccttcccaagattaaaccaggaagaagttgaatctctgagtagaccaataacaggctctgaaattgaggcaataattaatatcctaccaacctaaaaaagtccaggaccagatggatttacagccaaattctaccagaggttcaaagaggagctggtaccattccttctgaaactattccaatgaatagaaaaagagagaatcctccctaactcatttgatgaggccaacatcatcctgataccaaagcctggcagagacacaacaaaaaaagagaattgtagaccaatatccctgatgatcattagtgcgaaaatcctcaataaaataccggcaaaccaaatccagcagcacatcaaaaagcttatccaccacgatcaagttggcttcatccctgggaagcaaggctggttcaacatatgcaaatcaataaacataatccatcacataaacataaccaacaacaaaaaccacatgattacctcaatagatgcagaaaaggccttcgacagaattcaacagcacttcatgctaaaaactctcaataaactaggtattgatggaacaaatctcaatataataagagctatttatgacaaacccacagccaatatcatactgaatgggcaaaaactggaagcattgccttgaaaactggcacaaggcaaggatgcttgtctcaccactactattcaacataatgttggaagttctggccaggccaatcaggcaggagaaagaaataaagggtattcaattaggaaattaggaagtcaaattgtctctgtttgcagatgacatgattgtgtatttagaaaactccatcatctcagcccaaaatctccttaagcagataagcaacttcagcaaagtctcaggatacaaaatcaatgtgcaaaaatcacaagcattcctatacaccaataacagacaaacagagagctaactcataagtgaactccctttcacaattgcttcaaagagaataaaatacctaggaatccaactaacaagggatgtgaaggacctcttcaaggagagttacaaaccactgctcaatgaaataaaagaggacacaaacaaatggaagaacattccacgctcatggataggaagaatcaatatcatgaaagtggccatactgcccaaagtaatttatagattcaatgccatccccatcaagctaccaatggctttcttcacagaattggaaaaaactactttaaagttcatatggaaccaaaagagagcgtatgttgccaacacaattctaggcaaaaagaaccaagctggaggcatcacgctacctgacttcaaactatactacaaggccacagtaaccaaaacagcatggtacgggtaccaaaacagagatatagaccaaaggaatagaatagaggcctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaatacaagatggattaaagacttaaatgttagacctaaaaccatgaaaaccctagaacaaaacctaggcaatacaattcaggacataggcatgggcaaggacttcatgacaaaaacaccaaaagcaatggcaacaaaagccaaaacagacaaatgagatctaattaaactaaagagcttctgcatggcaaacaaactaccattagagtgaacaggcaacctacagaatgggagaaaatttttgcaatctacccatctgacaaagggctaatatccagaatctgcaaagaactcaaacaaatttacaagagaaaaacaaacaaccccatcaaaaagttggcaaagggtgtgaacagacacttctctaaagaagacatctatacagccaacagacacatgaaaaaatgctcatcatcactggtcatcagagaaatgcaaatcaaaccacaatgagataccatctcatgagagttagaatggcaatcattaaaaagtcaggaaacaacagatgctggagaggatgtggagaaatacgaacacttttacactgttggtgagagtgtaaattagttcaaccattgtggaagacagtgtggcgattcctcaaggatttagaactagaattaccatttgacccagcaatcccattactgggtatatacccaaaggactgtaaatcatgctactataaagacacatgcatatgtatgtttattgtggcactgttcacaatagcaaagacttggaaccaacccaaatgtccatcaatgataggctggattaagaaaatgtgacacatatacaacatggaatactatgcagccataaaaagtatgagttcatgtccttttcagggacatggataaaactggaaaccatcattctcagcaagctatcacaaggacagaaaaccaaacatcacatgttctcactcataggtgggaattgaacaatgagatcacttggatacagggaggggaatatcacacactggggcatgtcaggggttggggggctgggggaaggatagcattaggagaaatatctaatgtaaatgattagttgatggaggcagcaaaccaacatgacacatgtatacctacgtatcaaacctgcacgctgtgcacatgtaccctagaacttagagtataataaaaaaaaatcagtggttcattctcaatcttaagagaaaagcattcactctttcaccattgcgatgttaggtttagcttttgtttgaatcatcttgagataagataaaatatatataagatatatatgtataagatatatatatattttatgacagtactacactctcttgattattgtacctttgtagtaagttttaatattgggaagtattagtcctccaactttgttgttcttttccaagattgttttaactatttggggtaacttgcatttccatacaaaatattgtaaaaattttaggatcatcttgccaatttctattttaaaaatgcagctggaattttgatagggattttgttgaatctatagatcaatttggagagttttgtcatcttaacaatattaagtcttctaatccaaggacatggaatgtctttccatttgcttaggttttctttaatttctttcaacaatgttttgtatttttcattttataagttttccacttattttgttaaatttattcctaaatattttattttttgatgctattgtaaatggaatcaatttcttaatttcatttttggtttgcttactgctactgtatacaaataaaattgatattttgtataatgatcttgtaccctgcaaccctatttaacttgtttattagttctaattatttttagtggattcctcaggatgttctggacactggtcatgtcatctgcaattagagattatttaaattctttctttccaatcagggtggcttttatttcattttcttgcataattgtcctggctacagcctccaatacaatgttgactagaaacgacaaaggtgttcctaatcttagggggaaatcttttagtctttcactattaattatgacgttagctgtgggtttttcatagatgctctttaccacgttgatgaatttccttcctatctgtagcttgttgagtgctttatcataaaagggtgttaaattttgtaaaaagtctttctctgtgtctattgaaatgatcatgtggttttgtcctttatggtattgaagtggtatattacattaattgattttgcagatgttaaaacaaccttgaattcctgggatgaatctcggtaggttataattgtgtaatcctcttttatttgttattggtttcatttggctatttttttgtttttgttttttatttgtttgtttgttttaaggcagtccccccctctactcctagttttctgagaggtaggtttggtttgttttttttattgtcaggaatgaatgttagattttatcaattgcttttctgcatcaattgataagattatattatttttcttatttaacctattgatatggtggattacaatggttgattttgtaatattgaactaactttgcatccatggaataaaccgtagttggtcatgatgtataattcttttcaaataatgctgaattctattgactaatattttgttaagaatatttgaatcatatttatgaaggatattggtttgtgccttctttctttttctttctttcttcctttcttctttcttttttctttctttctttctctctgtctctttctttctttctttctttctttttctttctttcttctttccttctctctctctctctttctttctttccttctttcttttgtactgtctttgtctggttttgttatcagagaataaatactagcctcaaaagtgaattggaaagtgtttttctcccctttccactttctggaagacattgttgagaattggtgttaattcttctttgaatatttggtagaattcctcagtgaaaacttctgatcttggaaaccttgttggggggctttgaaattacaaattcagttttctcaaaagttataggtctattcaaattatctattttatattggctgatttgtgatgcattatgcatttcaaagaatgattaatttcatctacattgtcaaattaatgtgtatagaattgcttgtactactccattttatccttataatgtttatagggtctgcagtgatattttcattcagatgttggtaatttgtgtcttctctctttttctttatcagtcttgaaggatcaattcagtcaattttcttgatcttttcagaaaccagctcttgttttattcattttctctattacttttcttttttttttttttttttttttgacagagtctggcactgtcacccaggctggagtgcagtggcgccatctctgcccactgcaagctctgcctctcgggttcatgccattcttctgcctcagcctgcggagtagctgagactacaggtgccgccacctcgcctggctaattttttgtattttcagtagagacggggtttcaccgtgttagccaggatggtctcgatctcctgacctcgtgatctggccttggcctcccaaagtgctgggattacaggcatgagccactgcacccagcctacttttctcttttcaacttcactgatttctgctcatatatttattattttattccttctacttactttgagtttatgttgtttttcattttccagtttcttgaggtgggagcttgattactgattcaagacttttcctcttttctaatatatgcattgagtgctataaatttccctctcagcactgctttagcagtgtcccacacattttggtatgttgcatcttcattttcattctgatctgtaggttagaagtcctggcagacttgacagggctttctgtttaaagtgtcagctgggttggactcatatctggaggttctgtggatgaatctacttccaagctcattcaggtgtaggcagaattcagtttctttgggttgtagatttgaagtgcccatttccttgctgattgtctgctaacagtcacattctgctcctagaagccacttgaattcctccttagtgacccactccatcctcaaaaccatcaactagcaatctcgcatgtcaaaatattctcatgcctcaaatctccctgacttcctcttccatttatcagtcagagaaaaccatgttattaaagggttcctatgatgagattacacacactcagataatctgttttgccatgtaatgtaacataatcattggagtaatttctcatcatgttgataggttccacccacactcagaggggaggggattatacagaagcaagggtcatttgggtggtcatagttaaaattctccctaccacagtaattatctaattcaaagaaaaatattgggaaaatggtatgaccaaaatattgaggagtgcatgacaacagtttgggacccaacggagtagttcattttaaggtccattccaaattctatgattctgtagtagggaagtcatggaatattctgcttttctgtctattgtaggggccaagggataactttccccttggccttctgaaggttccctgaaaaatcaactcataaaaggcagatggataggagaaacgacatacacatttaacatacgtgtacatgggagccttcagaatgaagacccaaagatacagagaaaattttccattttatgcttaggtcaaaaaagtatggacagccatgtagaaatatgattagacataaagagcataatccaatgcaatagactcagtggggaaatacatcaaagcctctctgtctagattcttctaggcctctctgaacatgaattcctttcttctgggtgtggggcatgaccctctctggaacagagatcttatgacctgcagtcaaacaaggtaggtcagatcgtttctttgtggttagtttatacacagaaagacagagggaaagttagagtaatatttttaggtttcatggctggatttggggagaaggggtcggtttctatcactcgtcttagggaaaagagattctaggttctgtggctagcctccagggaggatgggattgagagacaagagggcaggagaaggtcagagaataacatttgcttctgaggccttcattttggggtactgttttctgagctccaacactccagtgaggtgaggtacagcaaaaaccagaggccagtatattctttaaaaatatcaaggtcatgaaagataagaaaaactgagaaactgtttccaattaaaggagactgaagagatatggaaactaaagttaagaattcattcatatttggatcttttactaaataatttttgaccttttgttctaaaggttgacattgggataattggtgacatttgaaagaggtttttagattagatcataatgttgcatgaatattaatttcctgattttgataattgtggttatgtaagagaatgctcttgatttttagaaacatgaactaaagtatttaaagataaaggggcatgatctccatcttactctcaaatgattgagaaaaaatagtgtgtgtgtgtgtgtgtgtgtgtgtgtacagaaaaagagaaaaggataaagaaaatgttgcaaaggttaacatttggggaatctgagtgaggagtacgtggaaattccttgtacttacatttatcctttctactaacagagcttcagatgaaaatcacaaccctggccaacaccttgatttcaatgcaatgagaccctaagtagaagattcaggcatactgtgcctgtacttctgacccacagaaactgtacaaaaataaatttgtgtgttttttaaaagtgaggccaatggtgtgtaagaagaatttgaagtgggaaaaaagggtagattcaggagacattatggagagaaaattgccacaatatggtgttttccttggctagatatgggtagagagagaagagttggggatgattctgaagttgggagcctagaaattgggataatgctggcagaaagaggcaaatagagggagagctgggtgggagaaaaaaaatgatgttttagaaattctgagcttgagtgaacagaggacatgagtaaaagggaaccatctagtggaaaggaattggttaaggattgaagctgaacagagaggtcagggctgcagccagaggtttgggaggcatcaccattgttttggatgtatttggaatccctgttgtaaagggaagaaagaggctgaaaatagaacgatatatttgagtccactcctgcacaccaagttggttgtgaggacttgcactgaagacagacagatctaggtttaaatcctggctttgctcatgcctagctctgtgacgctgaacaagtgcctaaacctctctgagcctctgcttttcttttattcagctatgaaatggtgacactgatcatacctgccttgtggtgaggactaaatgagataacctatatataaagcacttagctcatcgcctggaacataggttgcgctgaagaaattggggttatgattgttactgttgtttcctttcatgtgattttctgcattaggcagccttctcccgaaaagaaccctgacaattcagatcactgtgtgttttgttttgttttgttttgctggtgggaatgaggcaaggcgaccatagcatggcatcttttgcttatggagggcaggtccacaacctgttactgaaaagggtgaactttttctttttctgtcaatacgggcagatgaagagaaaagcacaaggagctctaggaagggaaagttggagctgtggctaatggagcaagggcagaccccaaagactcatctagatcatcagtgatgattcattcctccgaagcctttcctaggccattctgagaaacactggaggaagtgggatggcatgatctagtgtgagtgatgggcactgtgcacaaggggatgatttgtatttatgaaaggttcttggtgcctaggctgcctgatgcatgtctaaaaaggcagtgggttccaagtcaatgtgcctggagtgaggagatttagcttcacctgctggcactgactttccctacagaagatgtagctctgggcaccacactcctagcttacatttgatccctcctgctgaagcagtaatcaatctgcagtcttctgctattagatgttaatgcaatcaaagagatcacaatgaccttaagatttcctgattaattcactttttcccctagtcagcattaccttctttaatttctcagcacttggctcgttttctcagctcacttggctctgtttcatgctacaagtacctttttcctctactgaggagagggtttgggtagagtgatggcgttctgggctgcctggtagtggaagatggagaatccctgtccttgaataaaggtgtactacccaaaaagaaaggttttggggttttgacaaaaagcaatcttagaaaaggacatttggaaatggtaagagaaagacagagagagagaggatgtgtgtgtttgtgtgcatgtgtgtgtatgtctgcgtgtgtgtgtgtgtgtgtgaaagagagagagagaaatcttgagaaactggtaggaacaaagtaaaattattatttcctctcaagtcaaagaaggtacagaaagaaaactgccgaggtgaagatacgtatcagggattaccaattttccagagccccccacgcataaagtgctttaagatcctcagtgaggagaagcttaagatacagagactgatgatctgccaccataggtgggcagctggagttgatacaagctgcccaaagcagaatttgtgatttttttctgcaaatacattcctcttccagtcaaccccactcagtaaatggcactaccgctcacctggttgcttaagtcaaactcctggtggttatcctgagttcttcttgttcccttacacatcacatcctagtcatcagcaaatcctgttcatttaccttgaaaatatttactgaatttcatcacttttcaccacctcctcagccattagctagtgtgagccaccatcatctctttcccaaaccactgcaacagccccctaaataatctacttgcttccgctcttactgccaggcctgccatgtatggatgttcaggttgtatactacacaagggcaccatagctatgggtgtgccatttatatcacagacacatacatacttacataagattgtgcagatgggtgcagacattctgggcttcttggctctaagtctgacaacagcggaagagagcctgctcctacttaaaactgtaccagtgcacatggccttgcatagactcaggaaagcacaatcacacacacacatacacacacatatacatccataaatgtacatactcagtggcacacacaagtggactctatcctacccaagccctgggtgtcccctgagtttacttctctctctactacccattgttcccacaggctgaagtcccatccctcccacttccagctgcctcagctggagaggggatagaacagtggggggcaaagtgttgttgatggtgcatctattccagtgacaagaaatgcatgagtgagaggaataatgtgggtgctcacaacacaggctgctgcccaccatgactctggcaaactttcttgggcaggacttaaatttgtttaggttgtacaagaaaagactaacataatttttgttgtcatttttaaaatgaggaaggggtgtcttttttgtgattcacacagacactgtatcagatagtggcagccttacgcccccccgcccccgccaaatctcaactccaaccaatctctactctatataacagtcactaagaactttaacaaacaggctgggtacaggggttcaagactgtaattccagcactttgggaggtcagggcgggcaaatcgcttgagcccaggagtttgagaccagcctgggccatgtggtgaaaccccatctctactaaaaatacaaaaattagccaggcgtgttggtgcacacctgtagtcccacctactcaggaggctgaggtgagaggactgcttgagccctggagatcgaggctgcagtgagctgagaaaaataaaaaaataactttaacgaacacttgagtatgttgattctttgcttaaagccttccatttatattttaatgtttttaggataaagataaaactccttagatggcctacaaagcttgaatgatctggcccctgccttcctctgcaacctcatctcatatcaccctccctctcatgactgccccaaaccccacccacactgattttctgtcccttgagttcaccaagcacatatcattgtatttcttgtttatctgcctcccccttcctcctacctccctgcttctagagtgttaactctgttaagcagggactttgtctttttcatcattatgtcttcatcacctagcacagttcctggcatttaataggtggtcaataagtatttgctgagtgaataaataagtgaacaggaaaatgagcaattttgctccctattccactcattggctctaagatgaacctcagctcagcctcatctctagtgtgctttgagatcctctggtgaaatgagatggccagaaaatgcaaggttgttaaacatcagaaagttgcaagaccagtttggtcaggaggaataataatcagtataaccagcacgtattgagatattagcatgtgctgggcattgctctaggcttttttctcatttaatctccacagtaaccttataaggtatttcctagtatagaattatccacatttgatgatgagcaaactgaaacccaggtgattcagtgacttggatgcagacacaggcagttcgattcaaagctttcttttgtgttgtgtgagaatgagaacagtctcatttccactgatttctttttcaaaccaccctaggattatccctctaccccctggcttctcttcaatctcataatcttgaatccagccctgaggagcaggtagaaaagagccatgtactacattggtaagctgcagtgagtgtaggtctagttagtgtccccatagggtagcagctactttgatgattgacaatataaatttaaaagctgagatatcctgtactatcttgatactgaaatcaataaaaccatcaaatcctaagccagcctcaccaaactaaaagggagttgcaaccacaaagcaaatttaacacctcttggaatctttctgacatcacatgaagcactacctctgaggtgagaatggcattagcttgaagctctacagggctgaaaccttagctattacagggctggattgtatctgccaccttcacatgggaagagaaattgacatggggggaagagacaactgactaggcagtctttgcagctctgactgtgcataaagagaatgaaaaaataaaagaagagagggaaaacacagcataatcctcattgttaagatgttatcatgctcatgggcataacagaaattactgttcttcatctcaccttatgattccctttaacaaaagacaaccattgaaaacacaatttgaggccagtttaccccttcatgctcagagcctgaatcacaaattcatgggctgtattaaatgctttccccacttattttatcagattcttagaaccagagaaggaacctaatagaatatctggttcaactcattcacattttctagatagggagactgaggccaaaagaaaggggtcttgatttcattttcaccaagtgtacgcgtgtgtgtgtgtgtgtgtgtgtgtatgtgtgtgtccattcgtgtgttgcatgagtgggaggtttgcttcaggagctgttaaggggagagatggaaagttctgtattctaaaaggaaaggggtgaaaaatgttagaatcaatacagtgtttggtaaataactagtaatttgtcacataaacatatacacactacaaacaccactgtctgtggcagaaacagagggatgttctcaacagagggagggtctcagccaagaaggataaatgagggccattcatcctttcagaccctttctgccattggcaaagattggtccagtccactgcctaggttttctgtgggctctcaacattttgctcagcagagacttcccaaggctgcttcactagtggctggtggcatttaacctctgtgggagggatggagctttttcttttcatcatggaatccattatttttctttgaagcatagtgcaaagcttcttacaaattgcatggcaaaaatagaaatgcagccagttctcagcacagccttgtggaagtcggggcaacctgtccctcaggcagtgtggatggagagtgtgttcatttctgaacttgatggtaaatcctatggggaaggaggcagaaagcaacccatcccttcctcttctcccttaaagggaactagacctaaaatgtgttggagctgtgagccctggagaaagccagcccaattgcagtattagaccccgccagagggagtcagagtgtggcagcttggctgtgaacttgccgtgagacctggagtaagttgcttcccctctttgggtctctgttttttcatttaaccctcatgcttcacagaatgattgaaaggtacaaatgtagagaaaatagacccacatatgctttggaaacagtaaaaacctgatattagtacaaaatatttttattgtcattgttttatgtctgctctttgtctctggtggttgacctggaatttgggtatctgatctggaatttgacttggtatagaatatttcaggataggttcaaggcctctggagctgcagaaagaagaattgttggaagagtcaatgcaggttgaacactgggctcaaacagacccctcacaaatcacagccctgctccttcattaatctccccgggtatgtcttccagcagcttatcgaacctctgagcttcagtttcctcatctctaaagtggggttgttgtgggaatttaagtgagataataaatgaaagctattatgctgaagcactggtgtggagtatgcatttgataataattctttttgatgttatttgcatctgtgtgctgagaataactgtgattccttaatgtcagtgcacagctagtccttgttaaaacatacagattcctgggccttgccctaaagaaattctgattccataggtttggaatggagaacaagaacatgtgtttaacaaggactccacggtattctgatgtgggtccaatttggaaaccattggtgtagagcactgttattcaagctgtcaattgttacccactgctcagaaaatcaatttagtggatagtgaccagcattaaacacacatacaggaatggaatgggaaataacagggtacactgcacacagtaagggtaaatattgagttataaaatgtttataattacatataattttaaatataaagacagttatatttatcatttataatatagttgtatatacatcgtttgtgtgtatgtgtatatatatacatgcaaacatttcatgaggcaatacttaccctcactgtagataccttgacattggacaaaattatttgaaatactcatttcttatttggagaaactggcatccagagaattaatctgtcaagtctcagataagacaagaaatgaccaacaagggaatggagtaggatccatttctcctctctccccatctctcccatgctattcttggatcaacagagttggtggttctctaattagaatcagttctaatatcatataatggccctggcctgaaatgtaagggcaagttagggaggcggctgcaggtatcaggctaatggcattgaccccattagacggaaaatgcatctgggtttatgggatgtttagctgctcttggttagtgaaggctttgtataagtgtgccaagctcttgtccaaacaactgctcctcctttccttctcccagactttgatattgattttaccatttgaaactcttttgttgcctctgtaaaatcaaataattagcttaaaactatccttccggtcacatcaaccagcatcatcttttcagtcctgacttgatatgttgaagatgttagcacccctaacctttcatccacatgctctgtctaaagggagcagctatttctgggttccagttcattatggtcctgtgggaatgtggtcactttgccagtgaggccttctgtgtctaccctctgtgatactctaggccttgcaggaacctactactcttaccatttcaaaactcttcatctcctacctgactttgtattttcctgatggtacttatcatacaacttaacatagtatattttaaataataaacagataatgaaaataatcccatgtgtccagatattttttttctaggaagattgaaaatcaaattttatgtgaagttttccaatttttaatgctgccagatattttgatttttctagagagcttggacatctgaatattcatgtaaaatcttgtaatttttcaatgtcggttaccagttcatagaaaatttaaatactatttgcaccaaagaaaatatgtttgtgatccagatagagtccaaggttcaccctattgtgatctgtgtcatagatctgtagaacactggcgctgtgagaagccttgtaaattggcagcttctaatgaggaagtacagactcagaaagattaggtatcttctgcattatcacacagctggcttgtagcagaactggatctcgaacccagctttcctgcctcctagttgctctgtcatagtcaccatgctggctgcctcccttctgctgagggttgagttaatctgctctgtgtagaggacagctttcagtcttcagtcccctcctcctaaagaatataacagacgcatcaccacccatctgataatccccaggcacttctcaccagagtgtatgaatttacctgccttcccaatctcaactgaggatattgcctcttggcgctctttattgcttttgctccagtgatagaatcaagacaaagtctttataggaatgttattatcattgctcccagacagcggtgtcttccggcagagtcatagagtcggtgtggtctaatgcaaagaatctggggctcaaagtccagacagctgggctcaattctcagatatgtgacctgagacaacttatttagcctctccggcactcaatttccttaactgtaaaaatgagaaaaataagatctgtctctcttgtgtctcagagctgctgtgaggctaaagtgagatgatatgtataagagcaccttggaaacagataaacattttacaacgatgagggtatagtatcattaaatcagcaaaataatgattaagcacctactatgtgacagtgaacataccatttatgcagggcatgccaagaagcataggcctatctgcctccatgagcttatagtctacctgagaagaagggacatagctgagtgggaagagagccagcactgcaaagctagagaccagggctgaaggaaatgtattgaccgtagaatgagagaaagaaattgtggtagaaaggggtgaccatggaaggattcctggagggagttgcatttaaactaagctttggaataaaaattcacaggctagggctggcaggagttaaaaaaaaaaaaaggatattcttttactggtcaggggcaacagcacaaataagggctgaaatcacaacgtatgctggaggtctaatctacatggacagaagggttcaagtagtggctctcagattattgcttatccagctttttcactggcctaaaacacaaaagagaaagtcaagggatgcttgctatgaagtcaaggtggggccaggcacggtggttcatgcctgtaatcccagcaatttgggaggctcagggaggcatattgcttgagcccaggagttcgagaccagccattggcaacatagcaaaacctcatctctaaaaaatacacaaaaattagctgggtgtggtggtgcaggcctgtagtcccaggtactcaggaggctgatctgggaggatcgcttgaaccctggaggcagaggttacagtgagccactgagattgcaccactgcactccagcctggatggcagagccagaccctgtctcaaaaaaaaaaagaaaagaaaaagaaaacaaaccaaggcagaggttaagtgtgggcacaggtttggttaattacatcacaggagggcctaatactataaaatgatcataatgattatttctgcctcatagggcttttctcagctttaaattacatgatgtgtgttaaacatttagcatagcacctgatacatgattagtactcaataaatgttagctatcatcatcatcaccagttttcatcttatactgaagttaggggacaataacatgggctttggaatctgtctaatattagttgtgtagccttggtcgagtcacatcacttcctcgtttctcggtttcctggtctttaaaatgggaatgacagtagtgccaactgaaaagggctattgtgaggattaaatgagttaatccaagtaaagtacttatcaccatgcctggtacatgataagcattcaatagatgttagctgctacagttattatggccagttgaccattaaggtaatatgacagcataactaaaacatgagaaaattgagaaaaataggcaatcatgccaaatcttactactaagacacatcttgttattatttttggatttggttcttaaatttaaaatttcttttgttgagaaaatcaagactgcaggagatggcatggatttgggatgcagcaggcatttcgttaaacacttaataagtaactactgtgtgctagccagtgttccagaagctgagatatgacaagaaaaaaaaacacacaggacaggcattattcctgtatttaaggaatttatagcccaatagaggtagtatggaaaacaaaataataaatataaaatattgtgttatgtgatattaagtactatggaaaatatcttcagatggggtgataaggagttgtaaaatggtcaggagtggtgagggagggttggagagtgaaccctgcagagcctataattttagagggtggtcagggtaggcctcaccaagaaggtaatcttttgaatccagccctaaaggaggtgagggagtaggtcatgtaggtatctcagggaagagcattgggagcagagagaacaggaagagcaaggtctttgaatcaggaggatatctggcatttatgaaactgccaagaagcccatgttgcagcaatggagtgaatgaagggaagagtattgggatgggaggtcagagaggtcacagagacaagtttgttaagggcattgactgccatttccagggagtgagatggaaagccacggaggagcttgttcagtgaaggacatgacccaacttatatgagctatttggcactcctataagcagtgggttttgaccccatagatcctgggcaataataaacaagaggcagcaactccaccattccctcagaactctccttaccactctgtagactgcagagagtggacttattgatcctgagggcgacacagagaggaattgatggcacggagaataggggaaaaagatgtaatctcttagagctgaaagggactcagtgcaattctgccaccgggcatctgttcattccgcctcgactaaaaccgtcactgccttatcagcttgctcagcctcttcttgcaggaccttctcaaggtcggaaagccttttgatgggtttactgaaaatctgcctccttttcaccaccgggtggcagtagtcctggttctatcacctgagcaacccagaataagtgcataccttccgcaggaaaatacttgagatttgaaggcaggtggatatcttatatatcccccaacgtttctcctttacaggccctattgtctcttctaccttcaagagtaactcctattatagaatggttttcttttgtcaatcttgcaaccctcttctggaggttttccactttcttagtgactctcttaaaatgtgatgtctaaaattgaacaggagacggcaggagtgaacagaggaggttacagtgcaatgattatattctaggatctagaaactgtactttgattatgcaatctaaaattgtgctctgtttttagcgactaaataatttaggtacattaaactgttggctcgaattgtgcttgtgggtcaattcaagccccttgatcttttttagtttgtttatttgtttgatgtgagttgctgtgaagccacacttcccctattttggcctcacaaaatggacttttaaaatttgaattgatgattttttttctttatctcatttatatttcaccatttaaattttagcccagtattccaacccgtctgagcttattttgaatctcaattttgttcttcaacatattccgacatccctgccaggtttgagtcatcttaaaacacagtaagtacattttctgtatcacctaagttattaataaaaatgaaaaagtcttgtggcccttctctggagaacttctgctggattgccaatccatttgactgtattataacttgatcaatatgttactatcttgctttagttcattcatgagaaaattctgagacaaattcaaatgcatggctaaatccaagatatgttgtcaatgcaaaagatagcatggatgaaggtgatctaagataggatgtttttgttttgcaaaatggaaattctagtattgttttttccaattataaggtgatattggcttgttgtaaaggtcaacagcatacataagtatacaaaatacaaagggaaatttcctctgtaattctgtgcaccgacactgtactagataactatggttgacagttttatgcatatataaacacagatctatggttttactgggatcatgatatagagactgttacatgacctgctcttttcacttacaatcctttggaaacgtctgtccttctcagaaagtacagttttagctccttcttttaaacaatgatatagtgttcttttctttggatgtttcataatttatctcatcaatctcatattgatgggcatttagatcattggcaatttttgccgttacaagcagtattacatgttgaattgtctttgctgactcgatgagatgttgtgctagatgctggttgttgccttctctgtatttcccatcctcttgtccttctcagatattgttgtcaatgtcctaaatgccaaagggctgcttccgcctaagaactaatgagggggccaaattactactcatcatggtttgagtttgaaaatctatacttgccctactttcgagtgtgtttaaggctttttgagctgccaggggcttttagaggatcaaggcaccccaagatcaagccttgagggacagacagtcttgataggaggctgcaacccctgtttggcacatgtgaagtggttaggggcagaaaggagaaggagaactgccttgccattgggccacaattccttgttatacaccctcagccctgaccaagcaggacacttgctggtccctgaataagctcctcctttttcatgttcacacctttattcctccacagggtcttcctcctttcacacgtgtacctcccagaacaaggtaggagccatctgctctgaattcccagaatgctttaaaaccatgggcttgggagttgaaccaatgtttgaatatcagagcttggcagttgaacctagctctgtgatttttggataagtcttttatcctttctgggcctagttatcctcatctatggagtgatgatatgcctatatattttgaaacacctagcccagtgcctggcttaacaaacgtttgctgttattattatcataattaccatatgtgattatattacctactccactgttgtgaaaattaaatgagaacatatgtaaagcacacaacacagtgctcagcctaaaatgggtattaaataaattatggcaattactgattgtattcatatcttcctttggatacttatcttactctcttgtgttactcctatttgtgtttacgtcttgatctcctcctttaattaataagttccttcaaaagcacagtgtttgtcctcttccctcctcctacccctctcccctagaaagcataaaaaaaccagtgttggggttagtagggctctttaaaatttaggtgccgtcagcgaatgccaccatcactttgtctaagcccctttctgattggattttctagttagaaagcactgtctcattaacagatcaactgggccccctttctagggcaagtcatggcatacatattccaacccctgagccactgatcagaattagcaagctatagaatcttagctttggaaagattttcagaaaccaatggctttgtgtatgagtttacctgggcagaatggattcatgtaccactctcaggcctttgctatctagatggaaaggaacaacattaggccattagcccagtccagaccactgttgagtccctcttagactaccaaaacagtctcctaggctttttcctgctttcgctcatgcctctacacagcagcaagagcaatctttagaaaataaaaaatcagatcacatgatttccctcctcaaaaccctcccatggctcccattgcatgtagtataaattcatatttccttcccatggcctagaagaccctgaataatctggctcctgtgcatctctccacattcatcctgttacactcttccccttgccccctgtgcaccacctgcgctgatctactgttctgaggatacaccaagctcatccctgcttcagtgcttttaatcttgttttgaccctctaccaacaattgaatgccagccttgccccaacttccccatgtttcttttcgtccttcaggtttccatttcaattatactttctcagaagaacatgaaaagccttccctgtgcaccctgtctcaagtaggttcttgtccccacgttattctcaaactcattggttctcaggcttgcttcaaattgagaatcactcagagagcattaaaaaacaaaacaatggccaggcctcttctagatgaagtaaatcagaatttctgagaatggaactcagctatctgtatttctaaatgctcctcaagtggttttaatgtgtagccaaggtggacagcctttgttttatctgtcaacttgtttatttcattcttggtgcttatcacaaactataattattttgcttattttagcaacttatttagtaaatatttattatgcccctacatgtgccaggcactactcaaaacatggaaattaaactagtggacatactaaacacaaatcccaaccattatcaaacttcaattctagtggaggaggcagacaataaacaagatcaataaaatatatagtgaaatttttatagtgttctagactaaatggttgtgtcttccccaccaaattattgtgttgacatcttaacacccaatatgatagtatctgaagatgtggcttttgggatgcagttagggttagatgaggtcatgagggtggggctttgatctaatgggattagtgccttgataagaagagacaccaaagagcctgctctctctctctctctctatctctctctttcccccaccaccccaccacccaacatgcacaaagaagtcatataagcatacaatgagatggtggctgtctacaagccaagaaaagaggcctcagaatgaaacttacctttctggcaccttgatcttggacttccagcctccagaactgtcagggataaatgtctgttgttcaagccacccagtctgtagtattttgttatggcagtccaagcacattaagacatatagtatgttagagaatgatgagtgctagggagaaaagtaaactagataatggagatataaattttttggaggagagaaacactttagacagagtgacctcgatagataaatcttgagtaaagacctgaaagaagtgacagatatagatctgcagctatttggatgacgaacttttaaggcaaagaagagtctgtgcaaaggtcctaagactgtatcatacctagtatgtttgaagaacagcaagggggccggtatggctggaggtttgaagacaaggggaagagtggtaggtgataaattcaggaatttaatggggttgggggggcaggtgtttggaactttgaaggttattgtaagagctttggcttttactgagtaagaaggggtatcatagagcagagggtaatatcatctgacttagattttagtaggcttactatatatggtatgttgagaatacactgaagagggaaaagagtggaagcagaagaaccagttggagactactgtaataatccatgtgagacatgatgggggctcgaagaaggatgatagaaatggcaatgatatgagaaccaataagaaatggacacaaactgtatgtgttttgagagatagagtatttaggatttgctgacagacctataaataggacatgagataaagtacccagtcaaggatgatgccatggtttttagcctaggcatctataataatggagttgctatttacctgagatgggaagaactgtgggagaagtaggttttaggggaaatatcaaggaattagttttcaacttgttaagtttgatgtgcagctgtggtctgaaaatttgtgttctccccaaaatttctatgttgaaatgctaacccccaaagtgatagtattaggaggtgagagctttgggaggtgattaggtcatcacggaggagcctctacgaatggaagggattagtacccttataaaagagacctgagagtgaccattcactccttccactacgtgaggacacagcaagaagatgccgtctatgagaaagcgggccctcaccagacaccaccagcaccttgatcttggacgttctagcctctgaaactgtaagaaatacatttctattgtgcatgtgctatccagtttatggtatttcattatagtatcccaaatggaccaagacagatgcccattagacatccaagctggagatgtcaaatagagaattgaatatacaaaccttgaattcataggagaggtctggactcgggtcagaactttgggagtcataagactgaatgatcacttagagaataagttcaggtagaaaagagaagtccaaggactgatccctaaaccactccaatgtctaaaggttgggttgaagtgcaacaagcaaaggagactggaaagaagcagccagagaagaaagaagaaaaccaatagaatgtggttcctggaagccaagagaaggtgattcaaggaagagagagtggtcacttatgtcaagcactgcagatagctcaagtaagatgagaactgagaattggctgttgaattttgtaacataaaggtcactggtgatcttgatcagagcagtgataaaagtgagttcaagagagaagggaaggagacaatttggagattataagtataaacaaatgcttcaaggttttagtaaaatgaggaggacagcaatggggcagtagcagtatctagaagaggaattagggtcaaaagagggtttattaacttttttaggtaggagaaaaaatattcaaatgaaaagatccacctcctgcattagaatgtaagcttattgagggcaaggactttgtcttgtgcatattcagcaccttctatggtccctagcacatagcaggcactcaataaattttgttgaatggtgaatgatcaaatgaatgaagaaatgaataaataaacaaaagtagatgtcaatgagttgagcaagaaatactagcaggatagagtggcaggtgaattgagtagcaccttggctttagttctagtcattcctgccacactcctggcataccaaacttatcccaggcccagacggcttgtgaatgagttggcatggcacaactccctttgctaagagggcatgttatatctctgtagtcacttgttccagggagcagacaggctgttggactgtaagaatcaggtgcagccaggtgagactgtagagtccaggagtgtgccaaaagagatgcccctttgcatcatcaccattctctggtcctgatctgtctgtgatgcaggacatgggtgagacacatgctgcactggcatcccagcctgctcttacttgctggagggtagttaataacctcatgtaacacaggccaaggagcagctaaaccaaagtttaagaagaagaaacacatgcccatgcagtgaccagaagctttggcacccggctcatctcagttgctgcattgcacaatccccacaatttaaggtgatgggttggcccagtggggctcttgcatggtgcctatgactcagtttttgctagaaagatggcatggccccactccaggctggcacataggaggtgctcggcaagttttgaataaataaaccccttgggactgaggaaagaatgcttctttcgctttgcggagttcttcagtgctcagccagagccagattgtgaatctaggcagtctggcttcagggcctgtagactcagccacttaatttatacatgcaaggtattgggttttattgggggagtggtggtggtggtagtggtattattttttataaaagtaaaaaaaaaaaaaaaaagccaggtgcagtggctcatgtctgtaatcccagcactttgggaggccaaggcaggtggatcacttgaggtcaggagtttgagaacagcctggccaacatggtgaaaccctgtctccactaaaaatccaaaaattagccaggcatgttggcaggcgcctgtaatcccagctacttgggaggcacgagaatcgcttgaaccaagggggcgaaggttgcagtgagctaagatcgcgccactacattccaacttgggtgacagagtgagactctgtctcaaaaataaatatataaaagtttttttaaaaatcttgctatcacattatccaaatattatatccatattccctctcactggggcacatactacttgggttcctttgcctattattgttttgctttttggtagagaactcctaccatacccaaccatattaccttccccttcttcaaaagagattcccaggaatcctaatatcccacagaacataatctttccatttccagaaaggaatatggatgcctgttggttttgtccctttgtgtcttcacaagtactgagtgcctaccatgtgtcaggtcctgttttagtcaactggggatatagcagtgaccaaaacaattttaaaaaatcccaccctccacaacatcacttccatagcattcttgccaaaaaatgcactaccttaatctaactgtaagaaaaaagcagacaacacctgattgagggaaactctacaaaatagttggcctggacttgtcaaattgtcatgagagacaaaggttgaggaagcatcacagattagaggaggctaatgaggcatggcaactaaatacaatatgagatcctggattggatcctagaacaggaataggacattagtagagaaactgggaaaatgtgaataaggtctgtagatgagttaatcttattgtatcaatgttaatttcctggtttcaataatcttagtattattatgttaaggtgttaagattacaggaagctgggtgaagggtatatatggtaactctctgtgctatgtttgcaattttcctgtaaagtctaaaattatttcaaaataaaaaattaaaactagccctgccctcctggggcttaagtgctggaattgacagccagagagagaagaagggagggagagagagaaacaataagtaaaacaatcaggatattatttagtatattagcaggcaatggatgttatggagacaaagtaggaaagggaaatgaggagtagaggggctgtattcaagtaggatggtcgtggaaggcctcactgagatgacatttgaacaaagcctttaaagaagagggtgcaagagccacaaggtagagcacaccagtacgagggaaatgcaaaggtgctgagggcatggaatgcctgcccagtttaaagaaccacaggaagcctagtgtggctaaagcccaatgagcaaaatcagtttgccgcattctgtggttttaaaggtatcggaaagagactgaccacagaggaaagattagggaagtcaaacaaaggacatcaaatggaaggcctgctgttgtcctctgtttccaaccaagtcacagatgacagaaacatgaagggaaggaaagagcagggaagtaaaatcgctgaagtctagaatcactgtccaatttctggtgagtaaatagatccttattaagcaccataacaagtttctgagtctcctgtgttttattcctctccaagcactgaactataattaatgctgagtgtggcactggtatcacacagcctgtgacatcttcctgattttgtgctgtgtaaaatcatgagaagtgtaattggtagcacaaacgggtgggctgatttttcttggactaatgagtggaaatgatgaaaaatccagaacatttttttgatttggcttatgtttattatcaaaaattctcgacttattcaggtagcatcacttggatgtttgaggcctggtaatgcatgcactaaacagtatgcagtcaatgatgttgcttggcaagcagccccctggcctgatgtatacttacaaaagacaggccaggtaccagcggggtttcctaagggttcctcagctggtagctttgactgaggatgcttcctcttcaccaactatgcagaagcagatatccacatgggaggagccagcctaattcatgggaggcttggtgacagcaatgttgttttaggaacatctttgaccagtccacacaagagtgcttaaaaaaaaaaaaagattgtatgagaggatttagtgcttagtattctgaaaagtgtaaaatactgcataaggtattactataataataattattattatgtactatgatgaggtttaaagaaattaaaaggtctatagctataatgttttctagttccttacttgtttagtgttatgaaggatgccattaccctctttttagaaaggacagctaccattttgagcacttactatgtgccaggcactataataaatgccttgcatgtattgtttcatttagccctcacaataacaccatgaagtaggtactgttgatatccccattttaaaattgaggtaagtgaggctaagagatgttaaataacttacccaaggttgcacagtaagtggttagaaccaaaattatatgcaggagattggctctagaattctgtgtccttacgtctgtgctacagtaccatttaaaataagggatgcaggacacacatgctctgaaaaggcagatttaggtctccaagagggaaggcatcagctctgcttttggggctccatacacaaggataactgttaagaaggcccgaagcatgtggggcagctggagctcagactgatgtacttggatgtctgaagaggtgctaaggggctatctggcatcccaacttgaaagactgagctaggatgaagagcaatggacaaactctgaattctagaactacccagaatagccgtcacccacttcaccccatccttatgtctgtgaggaaactagagaggcagagcactgctgacacgtgcccaaggtcacacggttctctagagccagcagctgcagtagaactctggtcttcaggctcccagttcagtgctcatcctccaaccccacccccattagcccctcgcattcagtgggcagcagtcagaaagaaggcatctccttttgagtgaagctactgtctggagcagtggttctcagtgtagcccagggacctgcaacatcaacatcacctgggaacctgttagaaatgccaattcttgggtctttccctggaccaactggggctggggccctacaatgtgtgctgtaacaagccctcttgatgattctaatgtatgctgaagtttgaaacccactggtctagactgacaagcaaagcactgagtgctgcagatatcaatatgcatgtggagcatcaacttgcacagcacaaaggatagtcttcatagggaaggaatgtggaaaggactgcagccctcgagccacacctgcagcacagtgtcaccttcaaacacacatgatagtcacagatagatacacagagactgggagggagggtgtagccagtttttgttgatcttcagctgcatcaaagataatgtagttttgccagctcagcagttcgctagagacatgccagctactcggcttggtgctgtggaaggtgaagtccctgcacctcggggaaactgccacccaggattatagaacttccaaattgggagggagcttagagattatctactccattatccacctctaccactccttggtaatggcatccctgactggcactttctcagcttcagcattacagggccatagtgagagtgagctcagtttcttttaggacagcttggaggtgggagggagaagggaacttacacacaggtaactaccattacaaaaagtagtataagtgttagagccaatgctgtaagaacacagagccaggaggaatacattttagctgtgggagatcagggatgacttcatggaggagatgtcctttgagctgggcaagatttcagcaagcagacacagtggagtaggaggggttatttccaaagaagacaatatcatgaaaaacacttgaaggaatgaaaatccagaacaaatttcacaaaactatttaggcaggctaggttgagaggacacattctgcaacgagactgcttagcttaaaatactgactctgcaacttactggccacttgactttgggcaaattattgaacatctcttggcctctgttttcctacctgtaaaatgaaaataatacaacatacctgtgctatatcatattgggttgggagaaagagtaaatgagataatgctatgaactagctaacacagtgtctggcatatagcaagtgctccaggacagtttggcaagctttcttcatatataacaggaaatttgtttggagcactggcaatagaactgagagtagtggaggtaatctttgatactaggttgtggagagagcttagagtgccaaactaagaatttggggcttttattctgaaggcaggggatatgcgtagtaggaggatgaatgggaacagcggcaagggatagagagagttaagaagccactcgatcttacttaaggcagtgacaagttacctgaaaggaacaggacgagaatcaggttcagaggagagatatttgtgtgagtgtatgtctgaactatactgtcacatataaacctgactttgggttaacagcctgaaatgtacacatgtgtctattaaataattggagaataaaaattaatggttggagagaatattcgtcatttgttctattgtgaaagacaatcctttgttagctcgagtgaagctatgtgaaatattatatcctatgaaaacacttcctaaagttggcctttttgtaagaaaatttgggatatgtgcaattcacacatacttgatcaatttaagcacattctgttttactggcaggcaccaaaatctgtaataagacaaggagtcctccagtgaaagagatgattagagattgcaatagcagtgcacactgagctccaattaaggaatttcctaatggttgtctaggaatacaagtgccctccatttgggctttggtgataactagagtattctttagttgttaatcagagtgaacacaattcaaaatgttctcgactcgtgggtcagagggaatgatctcatttggcacattattgagtttctgagaagaggaaagatactaacagctcacaaatattttgttattgactaactgcaaagatgcatctgttaaagcaatccatctgagttggctagttctctcgaatattaaagaatatcaatatatactaaaagcaagtcaatttgtcaagcatttacaaagcaactttgaagccaaatgataccttttctgccttcccttctcttctagaagatactcacaaacacatacaaatctggactaaattccctctaacagaccctttgtaaagaaagctcactttctttggctgcagtgacacagatgtttgggtgggagggggtgcggagggtggcggaagcatgctggttcaatgcttgagaaacagtgctgcacccaacagactgaatgtcatgaattctttgtcagctccccctcagaccctccaggctttccctttgtctgctaagggatggaaacagaacagatacattgaagccggtagactgaccagctagattgacccaaattcattcaggaaatgcaaaagcctgctggctcctgggattagctggctggtgtttgaatcgctacccatctgtacatttccttctagtccagtgcagccccagcttgctacatctgctcacctcagcagcttgctttccaagacaagataatttgagaagagtctagttgtgagaaagcaatgtccaatgctagggaaactttgtggcaagcccgaagagaaatttggcccttatggtaagtgatttgctatatccccggtgttcttttcccaccatctgcccttgctcttctctaattctaggtaatgcagccaacttgtcaggcttagctttgtcgagaggatataccattttcaaggcttcattttttcataaggactgtgctaagcagctgtaagaaaaaataggatgaaaaaatgaatgttttgtttacattagtgaggtggcatcaaaaagcaatgaggaaaggcccagtacatctcatagacagttaattatgtcagaactcagactaaaggagacatggaggtctagacaaattatacccagggtttaccctgctgacaagagttcctatcccagcaatagacaggggtcacagaaaaagcctatagcacagtatttctcagccctgcacattagaatctcttggaaaactttaaaaaatatatatgcagagtcccctccctcagagattatgtcttaattgctatggagttagggccacagcattggtactttttaaaagctccccagatggaaaacaaaattgccacaaaggacatcattgagacaattagccacatttgaatatggactatatattaggtaatataattgtgtcagtgttaaaattactgaacttggtaaccatggtgctgtgattacgtaagaggatgtcctccttcttaggaaatatgcactaaagtatctagcggtgaaaggcatgatgtctgcaacaaactcaaatggattagggagaaaaacacctagaaatgtaaaggaggaataaagcaaatatggcaaaatgctaacaatttggctcatctgggtgaggggtatacagggtttttttggtactattcttagaactcttctgttggtttaaaattattttgaaatacaaaattctttttaaaaaataaaaaataaaacagatcccctgatgaaataaagcccaaccaaatttggaaaccattgggttcagtcaaatagagggaatggggacctgctatagataggtgagactgaaagcctttctgagacattatcctacatcagtgtttcttccactttaatgctcatacacatctcctggagatctggttaaaattcagtttctgattcggaaagtctgtagtgggacctgagaatctgcatttccctttctttctttctttctttctttctttctttctttctttttttttttttttgataagttttccctctgttgcctctgctggagtgtagtggtgtgatcatggctcaccgaagcgtcaactttccaggctcaagtgatcttcccgccttggcctcccaaacaaaatgttgagtttacaggcatgagttaccatgcccccctgagattctgcatttctaatagactccctggtgatgccaatgaggttattccatgggccaccctcagagtagcaattcttggactgaattaccccaccataaatttgtcagtcagtaaacaagtattttggaactgcaagaaaaattctctaagtggagtgggcctgcagagttctatggattggcagccccatcatcttgaccccttgaccatggcaactccccgtgagggattcagaaagtctgcagtggggcccaacctgccctgtgggagtcactctgatccacagaacagaacagagcacctagcagaataagcataaacaaaggcttgcagcaaatggaagaaggtatgaatggtctcttcaaaagcaagtttatgatacaagtcccaggagaagtgcagccctttccagtgggtggcagtggagccaagctgaggctcttatagagagcaacatagttctgatgaagtgtcagggtacaggctgcgtgggtccagctgcctcctccaggtgaggacccctttcttagaaataaaattccaaggaggattcccatttcatgctggctgtggcatgctttgagtttgttgcttccactgtaagtggagaaccaaaatgtctctcacttggaggaccctgcttccatcagaacttcccaaaccttgctctaccatttccccctcaaggtagctcctttcccctctgcctgtgtgttgtgattgtgctttccatgcattgaattagaggctatcctgttatttatatcttccttgtttacatccaaatcgaggccaactagtgtgaatgcacagaaggcaactgagctttactgagcatgcaaccccagagaaaagctctagaagacaaatgagaaaggccctggagttggtcagccctgagtttgtatcctcgctttaccacttaataagtgtgtgaactcgggcaagttacttaacatctctgagctttgggttcctcatctataaaatagggtcaataattgtactgacttcatagagttgtgagtattaaatcaaatagcgagtacagcaagtgctcaagaaatggaagatagtcatggacttgatgggcatttattaagtttcttctatgtgtagacaaagagtagttcaaatccagtctagtcctacttgctagttgtgcaatcttggatgagttgctttgttttacctctctgagcctcagttccgttactcttaagtgacactggtgctggtatataaatcacagaattgctgtaaggaataagtgaagtcagacatgttaaacacatgtcaggcacatataaatgtgctcagccaacatgaaatatcataattgttgtggttatcatgtcagctcttctctgagcacctttgtattatgagatttacttagcagccaagcacactttgcagcctcctccagtagaccctctccaatcttcactgtcatttccctgagggcggaggccctatcctttataccatttctggtgtctccatgacacctggcagtgagtaggtgttcagtgcatgaagcagagagcactatgctgcaagcacagccatcagaagcatcactgcctgggttcaagttttagcatgtccactttacttgctgggtgactttctagcaactcctggatcttctctgagtctccattctctcacatgtagtaagggtgtgataataattcctacctctggggattgctgcaaggattaaagctgggtacatagtgagagcttaataagggttgagtgttttaattgctgttattatttgagaaaagtcttacagtcaaggatcacaggagctactctgagaaatcatgcacacacatgcatagatacacacgagtgggcagcactgagaggacaggttacaggaaagacacaaataggcatttattgcccatgaaaggctctttgaaccccaagccagagccagtgtctgcctaaaattttctctgtaaccatggtactgagagcccctgagggtttttttttaatattgaagtaaaattcatataacagaaaatttatcattttaacatgaagaattcagtgacatttggtacattcacagtgttacagaaccacagctcttctgaattgattacccctttaagctggctgtatccagaggaaggcagggctcattgccttctgtaacccttcttgtcactattccatacctcttcacatccccactttgtttctccttcctcattttttcaattgtactctctctctccactctcctgctctttgggggcaaagggatatgtgtctctgatatacatgtacttttaggaagagtgaggatatttacccactggaaagattccaggtctaaaagatggcactggaagagtgcagaatgggactggtgaagccacttcttgccaggacaggcttggcacacctgaaagcaggcacagcacaatgtcagctgcccattgaccttagtcttcgtggccccagggtcaacagacaacctgaaaaggcttattatcaattatgacgtctgagaatcacagtcctgtttgttatcatgtcttctatctttggcctccccgttattatgagtaaatttgcttcatattaaagcatctattgcagaataaccttcataggctccacaacctcacagaatctgctttatatttgtacctatcggcaagagccacatcttaaatatattaaacaataagaataatactgcatatgtactgaattattcctgcatgccaagcactgcgctaaatgtgtttcatgagttatctcataaatgaatccttacaatgactctaggggccaggcattgttaatatctacttttaatagatcaggaaactaaggcacagagccaatggctgatttgtccaagagcaagtgacaaaacccatgctttacacggctgagtaatattgtggccccataatcccaccatggataattaacagaaaaaaaaatattcatttgcaaccacagacagtagcttccttcatccactgctagactttagtcttggttcatgaacttcctagtttttgacgttaggctgttcacctaacccatctgaaactgtttcttcctctatataattgtggaaattgtcctgccttacctcgctcagatttatgagtataaaatataaaaacatgcagggaatgtttttgcaaaatgtaaagtgctatgccaatgtcaggaactgacatcatgaataatggcttcttgggattatgtgagaaccacccagtttcatgctggggaattagagctccctaggagctctgtgataaccccgggaagctgcaagttcttctagccaaatcaaatccttgacaagccacgcccatttctactcttcatggttgtgtgaactcttaagtgctagctgatatggtttggatctgtattcccttcaaatctcatgtagaaatgtaattctcagtgttggaggtggggtcttatgggaggtgattggatcactggggcagattcctcatgaatggctaagtgccatccccttggtgatgagtgagttctcattctgagttcacataagatctggttgtttaaaagtgtgcagcacctttcccctgactctcttgctccctctctcaccatgtgatatgctggttcccccttcaccttctaccatgattgtaagtttcctgaagccctcaccagaatccaagcagatgttggtgccatgcttgtacagcctgcggaactgtgagacaattaaacctcttttctttataaatgaccaagccttaggcatttctttacagcaatacaaaaatggtctagcgcactagccaacttctctgaactcctaatctgtgtctttaaaatgtacttggaacagcactggaaaaatcctccacttttgatatatccggggctgaataaacccagtgaaagccttataagatgtcttctgcctgttctagttttgaaaaatcacagcctacctatcacagaggttgagatgcagattaacttgaggtgataaatttgaaagtgctttgcacagtgcttgcctcatagtgggtgctcaaaagatggtgcctcttttgtgattcagattgttattcttggggctgggggtggttaggtaggatgccaaagaagagagaggctgcagcaaggggaaggcagtttgggcagttgggactcctagaccacacggcttgccaatttcctgattcctcgaaatgaaggcatgattttgaaacacagctgcctcttactcacacaaaagcagtttatgcacaaggctgtgtctgacttcccatgtaggttatttgtgtttcccagaaatgttgggaaggtgtaggaagatgaagcctaattaagggtcttcctgttccaccacacttcatctccctggcatgcaagtggtttagcagcaaagcaggcagacaaaaagtctctcagcaagaaataacttttattatccctcaatgtagacatgcaggacagtggaccagaaaggctaggaagcagtggagggtagcagtcttttaaatactacatatcattcttttaaagaattattaagtgttttcagaaattgtaaattttccacgtattcattgccctcagtgaaacaatgcacaggaatgttctcctccgttcttctgcttctgcagtgtaagcagtattaacagcctgggttcaaatcctcccacaaccttctttgtgcacatgcaaccttctttgtattcaggcatgtaagacatccataggggattttgctgtttgtactagaatgggattgtgagatatatgtttctctacagcttggcttttgcacttaacagtgcatcacagacctcctagcacatcagtagttatagatctggtacattctttcaaaccactacatgatacttcataatatgaacaatatgaatatgccaggatttattaaactgtacatctatcgataagcacttgggttgtttagaacattgtagtcattctcagagactttttgtctgcctgctttgctgctaaaccacttgcatatcagggagatgaagtgtggtggaacaggaagacccttaactaattataatatggtaaacatatttaccagtgttggtaaatatggtgggaaagattgctgggtcaaagggttttaatttacttatggaaaaattgcttggctgatattcataaattgcattctgattccctcatcctattatcaaaaagtttattgttgatcagttaagcagatttcatttgccttcccaataatcaacgtatgacccatagtaaaggacggttgtaaagagtgggcatccaaggatatgatcttctcttcattgggatcccagaaatggtgggttgtaatttatctaactggactaatttctccagatgccttctttcactgacacaatccaattattctcctgccttttctagccacgatcaccttaggctcaaccttgagaaacaaaaagaaaacaaattttgttggcagcagacatgttttggttctccctcagataaagtttcctttgcaggacaataaaaggggaattggaaaggctggaaaagtaaggtgagcacaagttaacagaagatgaggaacatcaatctgctttactaaaggaattacttttgcaaaagtattgctgaatagtgcttttaagtatcaaggacatggtgggtacatgggggttcactgtaaaattatttcacatttgttttacaaactcttaaggtgttatttttttatttgcatttttttgagacagggtctttcactctgtcacccaggcgggagtgtggtggtacaataatggctcactgcagccttcactttcctggctcaagcaatttttcctacctcagcctactgagtagctgaaatcacagccatgtgtcacagcacccggcttattttttaattttttaaaaagatgtggtctcgctatgtttcccaggttgggccgaagcaagcctcccacctcagcttcccaaagtcttgggattacaggcgtgagccactgtgcctggccctgttaagatgttcatatgtggtttgatttataaaaattctgctcacatgccactttccaggcataaaatatctgtatcaagatactttgctgtgtgtgatactttatgctttttaaagcaatttcatttcacaatccaattctaccctcacagcatcatagtatgacaggaatcactcttctcatttgacaacagagataattaggcctggagaggtaaatgacttgtcaaaagtcacatacataattagcagcagagctaagccttaaattagggattccccatccagcatttgtctcacttggggaagatgggtagaacatgagaccctaattccatctctcattaggtctctgcttgagtcttatttggcctaactcaatttctgttttacttcaggcatgtagatccatgcttctttccatggctaatataacactgattgagcaccagtaatgcactaggtgctctagagactattgaattaaatctggttgctgccctgtagctcctattctgaatttgttggagcccaatctaaaatagttattgctctgcacagatagtacaggcgtataagaacatttctccaatctaagcttgtatctcaccatttttctttaggacccccaacagaatttcttcttatcaggcaggaatatcccacaactggtctctgagtagtcttaaaaaacagccctttattttgcctgactcactcttgaagatgaatgcatcagcttgttttctcttccagaataacatacagaggacagctttctcttctgaggagtcagaagttcagttcgcccaacatggaatgacttgaggtacacttgaatggtctctgtgtccctaaatatcttcctcatcagcagaaatgtcctctttgaagatgtgattccttgactacttcctgcctcttcatgttgtgtcagttacgtgatccattaaccaggctgtatgtatatcctttgaaatgtttcaaacatctttccctttgctaaccactcccacttgccactggctttgttatcttaaacagcaaagtcccagcagatctccctacttagcatcttttcctccagtctacactatatgctactggcaaaattatatttctaaaacaaagctctgattatattattcccctagtcaaaaaccatagtcggctttccactgcctgttgcagtggtgttcaaagtccatttgttcatttgtctgtttgttctttggtttcaaatcagcagcaccttttttttcaagtaaaaaaaattaggtagttaagatcccaaaatgtaaagcagataaaagtagacatgccttaaaaaatatgtagacacactgtagttgaagtgagaagttgggggtgagaaagtagggaagctctgggccccttgctcctggcagaacccttggtcctcagggaacacagtgtgaagaccactggcctgctcataagtttaaaatgcctttgcttgccattcaagactgcactaacctggccctaaactgcctctcccatgagacttccaattgtccttaaaggaaccctttgcttcagccgttcgttctgctctctgtcttccccacacaactgggacattctttacctttgcactgctaagcccccaagcctgaaatgtccactactgttcttggttcctgtctgacttgcattcaccctttgaaaaccagctctagttctacttactttaagaaatatttgccggcttccttgttccgcagggactcacttactggagctgtaatgactttatcttccaaaagaacaaaagagaagcagcccaggaaataaattcctatcaactctgtttttatgtgctccttctggctagagaagccttatgatgttaccactctctgaagtccctcttctgtaaaattgggacaataatagtagtcatctcagggattatgcaaggattaagttatatcaagctcctagcccagggtttagcactagtaaatagtataacttactagttatactagcaagtgtaactggtaagtagtataactagcaagttatactactaactagtatagtaagtagtatagtaagtagtataactcgcgagttatactactaactagtatagtgactggcttcttttttgtgactggcttctttcatttatcataatgtcctccaggttgatccatgttgtagcatgtgacaggatttcttccttttctatgactgaataatattccactgtatggatatatcatactttggttatccatccatctgttgatggacacttgggttgcttccaccttttgactattgtgaatatgctgctataaacattggtgtacaagtatctctttgagatactgtttttgactcttttgaatatatacccagatgtaaaattgctgtatcatattgtagttattgttttgtttgcttgatgaatctccatccagtttctcatagtggctgcaccattttacatccctaccagcaatgcacaagggttccaatttctcacatccttgcaaacccttgttattctctgttttcttgttgataatggccatcctattgggtgtaaggtgatatctcattgtggttatgatgtgtatttccctaatgattattgatgtagagcatcttctttgtgcttattagtcatttgtatatctctttggagaaatgcccattcaaatccttccaccatttttaaatcaggttatttgttgttgttgttgttgctgttgctgttgatttgtagaagttctttatatattctggatattaatcccttaacagatatgtggtttgcaaatatattctctcattcaatgggttgctctttcactcttgattgtttcctttgccacacagaagtttttaagttcaatgtagtcatatttgtctatttttgctctttagtgttattttaatgtgtctatatcctgtcttctcactgaaactcaaagctttccaaaggtacagtgcatgattcctcttgtgttgtctgttgtgtcatgctctgtgccacgcacatagtaggtgctcacgaatatgtaccaaccaattaattgaatctccatatgcacattaacctattatcagccatgagtgccttagcaaaattatttttttagttaactggaagcttagaggatagcatctatgattgggccaaaggagagacataggttggaggagtgaatagaaaacatggggccttctcaggaagaggagactctatggcagcaggtggggacattgtgcctgacatacggaaaggtccccataaatgttagctggtatcattatttgtgcactagctgtctgagacagggagaggcaatgctgggataactgaatggaaatatgagaaattcaaaagagaaactttttgtcagcttgccttcttaaaagtatgtgtgtgtgtgtgtgtgtgtacatatatatgtgcacacgtgctcaagtgccaagatccaaatttgttttgcgaccaggaagataattcactgtttgcgttatttccaagagtaaccattaatgcaggtagagaggaggaccacaaatgtgattactattcagtagactctttttggatgatgtccatgcattacttatctcacatatactacatcagtgctaaagaagaaaggaaggaaagaaggaaggaaggaagggagagagggagggagggagggaggggagaagaagagaggagaagagaggagaggagaggagaggaggcaaaagaagaaaggaataattaggagttgattaaagcacctgccctaggactcttggagataaataggattttctgacctgttactttattttaaaattaatgttgcctttggggctctcagtgctaaatagtgaaaactcaacaaagatagtagtccctgctttgggctggaaaacatcacaagggaaattagaaaacaccttgagatgaatgaaaatgaaaatacaacatatcaaaatttatggaacacggtgaaagcagtgctaaaagtgatattcatggctataaatgtttacattgagaaagaagttcttaaatcaacaacctaacttcacaccttaaggaattaaaaaataacaagctaaacccaaagctagcagaggaaagagaccaataaagattggaacagagataaataaaaatagtgaatagaaaataaaataaataaaatagaataaaatagagaacagcaatgaatccaagagatgtctctttgaaaagatcaacaaaattgacagagtttatagctagatcgactaagcaaaaaaaagagaagcctcaagtaactaaaatcagaaatgaaagcacagacattaccaaaaatgttaaaggaataaaaagattataagggagtacaatgaagaatggcatgttaacaaatgtggtaacctagataaaatggacaaatttgtagaaacatacagcctaccaatattgaattatgaagaaatagacaatgccaatacacctataactagtaaggtgatgaaatcagtaatcaaaataatttaaaggaagaaaagccaagatccaatgggttcacctctaatttccacaaaacatttaagagtaattaacatcaatttgtttcaaactcttaaaaaattaaagaaaagagaatatttcctaacttactctatgaagccagcattaccctgatatcaagctagaaagagacactgcaagagaactacagaccaatataccttatgaatattgatgcaaatatcctcagcaaaatactagcaaatagaattcaatagcatattaaaagggttatatgccttgagtaagtgggatttattcctcaaatgcattgatgggtcaacattaaaaaaatcaatcaatattatacaccacattaacagcatgaaggggaaaaccacatgaccatctcaagttacacagaaagagcattttacaaaattcaacacctttttgtgatttttaaaaagaactcaataaactaaaaatagaagaaaactacctcaacataataaggccatatatgaaaaacctacagctaacatcatgcttaatggtaaaagactgaaagcttttactcaatgatcagaacaagacaaggatgtcagctttttggcacctctattgaacatagtattagaatgcctagacagacagcaattaggcaagaaaaataaataaaaagaatctaaattgaaaaagaaaaagtaacattatctctctttacagacaatatgatcttctatatggaaaatgctgaagattttattttaaaaactattagaactaataaatcaatttgggaaattgtcaggctgtaaaatcaacatacaataatcagttgtagttctatacaccgacaacaagcaatctgaaaaggaaatgaagaaaacgatttcatttaaaatagtgtcaaaaagaataaaatacttaggaataaacttaaccaaggagacaaataaatgtgtactgaaaagtataaaacattgctgaaagagattaaagacacaaataaatggaaatatggaaatacatctcatgctcttagattgaaagacttaacatatttatgatgtcactacccaaagtgatctacagattcagtgcaatccttatcaaaaccccagtgacttttgttgcagaaataggaaaatccatcctaaaatttatatggaatctcaagggaccccagatgagtgaaacaatcatgaaacagagcaaagttggagaactcacacttcttaatttcaaaacatactacgaagcttacagtaatcaaaatattgtggcactgtcataatgacagacacatataccaatggagtagaagagagcccagaaataaaccctcattagatggtacctttttgtacccttttgacaagggcacaaagtccattcaatagggaaagagcaatctttccaacaaatggtggctgggaaaactggatatccacatgcaaaggaatgatgttgggcctttaccttacaccatatacataaattaacttaaaacagataaaacacctaaccataataactaaaactataaaactcttagaagaaaacataggggaaaatcttcgtgacattggatttggcaatgatttattgtatatgacatcaaaagcataggcaacaaaaaaatggataagttggatgtcattaaaattaaaaacctttatgtatcaaaagacaatatcagagtgaaaaggcatcctacagaatgagagaaagtatttgcaaatcctatatctggtaagggattgatatccagaattgtaaactcaacaacaaccacaaaattcgattataaaattatgcaaaggccaggcaaagtggttcttgcctgtaatcccagcactttgtgaggccaaagcaggaagacggcttgagcccagtagtttgagaccagcctgggcaacatggcaaaacaccatctttacaaaaaaaaaaaaaaaaattagcctggcatgtctcctgtagtcccagctactcaggaaactgaggtggcagaattgattgagcctaggaggttgaggctgcagtgacctgtggttgtgccactgcaatccagcttgggtgacagagtgagaccctgcctccaaaaaaaaaaaaagaaagaaagaaaagaaaaaggggggggggcaaatgatttgaatatacatttctccaaagaagatatacaaatgacctatatacacatgaaaaggtgcttgacatcactagtcattggagaaaggcaaatcaaaacaacaaatgagataccaccttacaccagtaggatggccattttacaaaccacacacacacacaaacacacaaaaaataacaagtgttagccaggatgtggagaaataggaactcatgtgcattgctggtgggaatgtaaaatggtacagctgctatggaaaatggtatgataattcctttaaaaattaaaaatagaattaccatatgatctagcagttctacttctgggtatatacccaaagaaattgaaagcagggacttcagtagatatttacacatccatgttccttgcagcattattcacaatagctaaaagttagaagcatcccaagtgtgcaccaacagatgaataaagaaaatgtatatgttactcatcctttgaaaggatggaaattctgacatattctacaggaatggatgaactttgaagacattatgctacgtgtaataagccagacaccaaaggacaaatattgtatgattccatttgtataaagtacttagagtactcaaatccatacaatcagaaagtagaatggtggtttccaggagctgagaggaggggagaatggggaattgttggttattgggtatacagtttcagttggggaagatgaaacatttctggagagagtgatgatgattgcacaacaatgtgaatgtaggcctgagggaggattaagatggcagataggaggcaggactagcttgcagctcccactcagacagacagagcagtgtatagagactctcatcatgaacttttgctccaagaactaccacaggaacataccagggaagccgagagaatccacagaccctttgaaggaactggatcaccactgcaggttccctgagatgtcaaaaacctgtgtctgtttgctttctcagccagtggggaggcttgtggtctggggtaagttctcagccctgatcattggctgcctagaaatagacttggtgctgttgtgggggtatggtggaagtgagaccggcctttaggactgtgggctctgtgggaaaggggtgaggcctgtgactgccagctttccaccacttccctggtgacctgtgtgacttatcagaggcagtcataatccccctgggtatataactccactggactgggaacaacacccccatcccccacagcagccacagcaaacactgcataaggagaggcggagctcagacatgcttatccctatccccaactagtggtctttctctacctgcccccgggaagacaaatgtcataatctcttgggagctctattgcccttcctacctcctgagaaacctgaatacttaatcaggtgtctttgcatcctccttgtagggccacagttgatgcactcctgaaagggttacctcctggctgggggccaaccaacacaaaaccagcccactacacaaaaacacaaccaaagaccctcacagagtccattttactcccctgctacctccaccagagcagctgctggtatgcaggactgcaagacctgaagacagattacatcacaggactctttgcagaaactccccagtaccagtctggagcccaatagctccactgggtggctagacccagaagagcaaaaacaaatcactacagcttagctctcaggaagcctctttcctagaggaaggggaaaataacacattaagggagcacccatgagacaaaacaatctgaacagcagccattgaaacctagatattccttctgacatgagaaggaaccagaaaaacaattctggtaatacgacaaaacaaggttctttaacaccccccaaagatcataccagctcaccagcaatggatccaaaccaagatgaaatctctgcagtgccagaaaaagaattcagaaggtcaattactaagctaatcaaggaggcactagagaaaggtaaagtccaacttaaagaaatcagaaacatgatataggatatgaacggaaaattcttcagtgaagtagatagcatgaataaaaaaaatcacaaccgcaggaaatcaaggacacacttagagaaatgcaaaatgcactggaaagtctcagtaatagaatcaaacaagcagaagagagaacttcagatctcgaagacaaagctttcaaattaacccaatccatcaaagaaaaagaaaaaagaatttttaaaaatgaacaaagcctccaagaagtttgagactatgttaaacatccaaagctaagaataattggtgctcccgaggaagaagagaaatctaaaagtttggaaaacatatttgagggaacaattgaggaaaacttccccagtcttgctagagatctagacatccaaatacaagaagctcaaagaacacctgggaaattcatcacaaaaagatcaccacctaggcacatagccatcaggttatctaaagtcaagacaaagaaaagaatcttcagagctgtgaggcaaaagcatcgggtaacttacaaaggaaaacctatcagattaacagcagatttctcagcagaaaccctataagctagaagggtttggcgacatatttttagcctccttcaacaaaacaattatcagccaagaattttgtatccagagcaactaagcttcataaatgaaggaaagacacagtcttttccagacaaacaaatgctaagagaattcgccactactaagccagcactaaaagaaatgctgaaacgatctctaaatctttaaacaaatcctcaaaatacaacaaaatagaacctccttaaagcataaatctcacaggacctatgtaacaataataccatgaaaaaaaacaaaaacaagttgttcaggcaacaaataacacaatgaatagaataatatcacacatctcaatactaacattgaaaatagatgacctgaatgctccacttgaaagatacagaatggcagaatagatatgaattcaacaaccaagtttctgctgtcttcaggagactcacctaacacataaggattcacataaacttaaggtaaaggggtagaaaaagatattccatgcaaacggacaccagaagtgagcaggagtagctattctttttatatatatatatatactttaagttctggggtacatgtgcacaatgtgcaggtttgttacataggtatacatgtgctgtgttggtttactgcacccatcaactcagcatttacattaggtatttctcctaatgctatccctcccccaggcccccactcactgacaggccccagtgtgtgatgttcccctctctgtgtccatgtgttctcattgttcaactcccacttatgagtgagaacacacggtgtttggttttctcatcttgtgttacattgctgagaatgttggtttccagtttcatccatgtccctgcaaaggacatgaactcatccttttttatggctgcatagtattccatggtgtatatgtaccacattttctttatccagtctctcattgatgggcatttgagttggttccaagactttgctgttgtgaacagtgctgcaataaacatacatgtgcatgtgtctttatagcagcatgatttataatcctttgggtatatacccagtaatgggattgctgggccaaatgctatttctagttctagatccttgaggaatctccatactgtcttccacagtggttgaactaatttacactcccaccaacagtgtaaaagtgttcctatttctccacatcctctccagcacctgttgtttcctgactttttaatgattgccattctaacaggcatgagatagtatctcattgtggttttgatctgcatttctctaatgaccagtgatgatgagcattttttcataagtttgttagctgcataaatgtcttcttttgagaagggtctgttcatatccttcacccatttttttgatggggttgtttgtttttttcttgtaaatgtgtttaaattctttgtagattctggatattagccctttgtcagatggatagattgtaaaaattttctcccaatctgtaggttgcctgttcactctgattatagtttcttttgctgtgcagaaactctttagtttaattagatcccacttgtctattttggcttttgttgctgttgctttttgtgttttactcatgaagtctttgcccatgcctatgtcctgaatggtattgcctaggttttcttctagggtttttatggtgttaggtcttacatttaagtctttaatccatcttgagttagtttttgtatatgatgtaaggaagggatccagtttcagctttctgcatatggctagccagttttcccagcaccatttattaaataggaaatcatttccccattgcttgtttttgtcaggtttgtcaaagatcagatggttgtagatgtgtggtgttatttctgaggcctctgttctgttccatttgtctatatctctgtgttggtacaggaccatgctgttttggttactgtagccttgtagtatagtttgaagtaaggtagagtgatgcctccagctttgttctttttgcttaggattgtcttggctatgtgggctctttttgtgttccatatgaaatttaaagtagttctttccaattctgtgaagaaagtcagtggtggcttgatagggatagcattgaatctataaattactttgggcagtttggccattttcacaattcttatatcagacaaaacaaactttaaagcaaagcagttaaaaaaggcaaggagggacattatataataataaaaggactagtccaacagaaaaaatcacaattctaaatatatatgcacctaaaactggagctcccaaatttattaaacaactactagacttaaaaattagatagacagcaacaaaataattgtgggggactttaatactccactgatggcactagataggtcatcaaaacagaaagtcaacaaagaaacaatgaacctaaactgtaccctacaacaaatggacttaacagatatttacagaacattctacccaacaacttcagaatatacattctattcattagcacatggaacattctccaagacagaccatatgataggccacaaaacgtgtatcagtaaatttaagaaaatcgaaattatatcaagtactctcttaaaccatagtggaataaagttggaaatcaactccaaaaggaaccctcaaaaccatgcaaatacatggaaattaaataatgtagtcctgaatgatccttgggtaaacaatgaaattcatatggaaattaaaataattatttgaactgaacaataataatgacacaacctatgaaaacctctggaatacagcaaaaagcagtgctaagaagaaagttagtagcattaaatgcctacatcaaaaagtctgaaagagcacaaatctaagatcacacctcacagaactagagaaacaagaacaacccaaacctaaacccagcagaagcaaagaaataacgaagatcagagcagaactaaatgaaattgaaacaaaaaaatacaaaagataaatgaaacaaaaagctggttatttgaaaagataaataaaattgatagaccattagcaagattaaccaagaaaataagagagaagatccaaataaacacaattagaaacaaaacgggagatattacaaccaacaccacagaaataccaaagatcattcaaggctactatgagcacctataagtgcataaactagaaaacctagaggaaatggataaattcctggaaatatacaaccctcctagattaaaccaggaagatacagaatctccaaacagatcaataacaagcagcgagattcaaatggtaatttaaaaattgccaacaacaaaaaatgtccaggacccaacggattcacaggtgaattctatcagacattcaaagaagaattggtaccaatcctattcatactattccacaagatagaaaaagagggaatcctccctaaatcattttataaagccagactaataccttaataccaaaaccaggaaaggatataacaaaaaaaaaaaaaagaaaactacagaccaatatcccgaaagtaggacatagatgcaaaagtcctcaacaaaatactagcaaaccaaatccaacagcatatcaaaaagataatccaccatgatcaagtgagtttcatatgagggatgcacagatagtttaatatatttaactcaataaatgtgatacaccacataaacagaatgtaaaacaaaaaatcacatgatcatctcaatagatgcagaaaaagcatttgacaaaatccagcattcctttatgattaaaaccctcagcaaatttgcatagaagggacataccttaaggtaataaaagccatctacaacaaacacatagccaatattatactgaatggggaaaagctgaaacattccccctgataactggaacaagataaggctgcccactttcaccacttctattcaacatagtactggaagtcctagccagagcaatcagacaagagaaagaaataaagggcatccaaattggtaaagaggaagtcaagctgtccctatttgctgatgatatgattgtatacctagaaaactctgaagactcttccaaaaagctcctagaactgggaaatgaattcggcaaagttttaggatacaaaattaatgtacacaaatcagtatctctgctatacaccaacagtgaccaagctgagatcaaataaagaactcaacccccttcccaatagctgtaaaaataaataaataaaatatttaggaatatacctaaccaaggaagtgaaagacctctacaaagaaaactacaaaacactgctgaaagaaatcatgggcaacacaaacaaatggaaacacttctcatgctcatggataggtagagtcagtattgtgaaaatgaccatactgccaaaagcagtggacaaattcagtgcaattcccatcaaattaccagcatcattcttcacagaactagaaaaaatatcctaaaattaatatggaagcaaaaaagagcccacatagccaaagcaagactaagaaaacagaacaaatctggaggcatcacattacctgacttcaaactatactacacagccatagtcatcaaaacagtatcgtagtggtataaaaataggcacataggtgaatgaaacagaatagagaacccagaaataaagccaaacacttagagccaacttatctttgacaaagcaaacaaaaccataaagtgaggaaaggacactctatgtacaaaaaatggtgttgggataattggcaagccacatgtagaagaatgaaactggattctcatctcacgccttgtacaaaaattaactaaagatggatcaaagacttaaatctaagacctgaaaccatgaagattctagaagattacatttaaaaaaaaaaaactcttctagacattggcttaggcaaagacttcatgaccaagaaccgaaaagcaaatgcaacaaaaacaaagataaatagatgggacttaactcaactaaaaagcttctgcacagcaaaataaataatcagcagagttaacagacaacccacagagtgggagaaaatcttcacaatctatacatctgacaaaggactaatgtccagagtctacaaagaactcaaacaaatcagcgagaaaaaaacaaacaatcccatcaaaaagtgggctaaggacacgaatagacgattctcaaaagaagatacacaaatggccaacaagcatatggaaaaatgctcaacatcactaattatcagggaaatataaatcaaaaccacaatgcaataccacctcactcctgcaagaatggccataataaaaaataaagaaataatagatgctggtgtggatgcagtgaaaagagaacacttttacactgttggtgggaatgtgaactagtacaaccactgtggaaaacagtgtgaagattccttaaagaagtaaaagtacatctaccatttgatccagcaatcccactactaggtatctatccagaggaaaagaagtcactatatgaaaaagatactttcatacacatgtttatagcagcacaatttgcaattgcatacatatggaagcagccgaaatgcccatcaatcaatgagtggataaagaaaatgtgatatgtgtatatatacatatatatgtatataatatatatgtgtgtgtgtgtatatatatatacatatatatgtgtgtatatatatatacacacaccatggaatactactcagccataaaaaggaatgaaataatggcattcacagcaacctggatggaactggagactattattctaagtgaagtaactcaggagtggaaaaccaaacatcgtatgttcttactcatatgtgggaactaagctatgaggacacaaaggcataagatacatttggctttggggacttgggggaaagggtgggagggggtgagggataaaagactagtcactgggtagagtgtacactgctcgggtgatgggtgcacaaaaatatcggaaatcaccactaaagaatttattcaggtaaacaaaaaccacctgttccccaaaaacgtattgaaattaaatttaaaaaagtgaatgtatttattgccacagatttgtacaagcaaaaatgattaaaatggtaaatttattttatgtatattttaccacaatgaaaaaagaatttgttagaaatccaaattgaaattttagtataagggaaaaataataatttaacaaaaaaaaagcaattaaaaattgaagcctgttttgtggtagaactaaaccaatatggaagtcagctagatacatctgttaataaaagttgggttgataaggtaaataaaaagcaataataggagcaaacacttagtaagcacttgctgtgttccaagtactttacaaacattatttaattttcacaaccacctgtggggaagctactgttattatccccaatatacagatgaggaaagtgaggctctctgttgagaccaggaagttcactgtgttgcctctaaaacacagtctcagctgggcacagtggctcatgcctataatttaagcactttgggaggctgaggccagacgattgcttcaggccacaagttcaagaccagcctggaaaaaatagggagaccctgtctctacaatttaaaaaaaaaaaattagctgtgccacagtggtgcactcctgtaatcccagctatttgagaggctgaagcaagtggattgcttgagcccaggagatgcaggctgctgtgggctgtggtcatgccactgcactccagcctggtaacagagcaagaccctgtctcaaaaataaataaaacaataaagaaataaagaaataacggcctctacctttgagcagatcacaatcaacaaagagaagcctataggcaatgataaaactctacaacatcatacatattgcaaggaatgtaggtatgaaatgctacaatagaacagacgaagatgcaatttcagttgaccctggaaccatatgggagttagggttgccaagcccccacacagtaaaaatcagtatataacttttcagtcccccaaaacttaactactaatagcccgccattgaccagaagcagtactgagaacataaacagtcaatcaacgtgtattttgtatgttatatgcattatatactgtattctcacaataaagtacaataaagtatgccaggaaaaatacaatattatcaagaaagtcatgaggaagagaaaatacttttactataccatactgcatttatcaataccgtaagcttgcatcatctgtttaaaagatgaatcgtctgtctgaaatagtgggccactgcagctgcagacctcaatctacagtacatatcaagcaatcaactttttcttgtagtgtcttgacttttctctgcttcttgggagcacttccagcatgactaatggcacttcgtgtggatctcctggtgttattcaaggtttacagcattgcactatatgtgatgaaaaacatgtaagaacaacaaggatcactttttactgtgatctgcaattaactggagagaggatctgcttacttgaagatgattagcatcacatggcattttaaggaacactcataatacttgagctcactacaagaacaacaggaggttggctacaaaatattacagcagtacagtgtgtactacaattaattttatgcagtcatgatttaatactgcatcattacatctgcttacatttctctcaactgtgaatggtgccatgtatggtctgtttgtgcataagttttgataaattttaactttttataatagatttgtgtatttttatgggagtaaatgataaaatatatgagtatctacatatattttatgcattcataacatatctttttggtttttttttaaatatttctaggcaacatggttcatctccgagttttcttgcccgtgttcactgaggagaaattttgtgtagaagagtggtagagttgatgtatgagaattattgggaatgtgtagtgagaaggaaggacaggactgaaaagatctagaaagcttaagagaagggctgcttagttcaactcaacaattgttaaagatccgatttccatatttgccaccagaattttcacatgacactccctttgagagactacattaattgtggagtttatttggctttaagattccaagaagattaaagccaaagattaaactactctatttatgttggccaaatagatgggtgggtggatggatgaagggatgttgaatgtatggatcatagatgaatgaatggatagttgaagggatgttggatggatggatggagctagatggaaggatggctagactattgctagactgagaaaaaggaaaaaaatctgagcttcatctgcttgtttcctgattgtttttgaagttcaggtagacctgcctcaagacatcatgaaatacttcctggttattttccacttctttaattacattttaaatgtacctaacagtgatacaaatgctgcatttagcttagttttaatacatttgaatgatgttaattctcactgtgaaagtttaagctacattacaagtcggtttgtagtcagctgtactagtaactgtcttagaatttggcaactggcgaacaactaactccacagaacccacctttacccttgtcccaaccaaattgcagcatgaactagtgatgtggtcaaagccagttgtttgaaatgactgattcagtggaaacaagacatttcactcattagcatatatatgcaaaacatataaattgattacctactgcaagacatttgtctcacatagctcctatgtttggggaggtcacagtctagtgaaatagatatgtggaacaaggaactagaatacagtaagtgaggactagattggaagtaggtagagagagctaggcaagtctagagcaaggggtgatgagctagagagggtcagagaaggctttgtatgggaaagaggtactgggaatccctggaaaccaaccctaaaagattaggcatcctcctgtagagaaaaggaaacaaatgaagggattctttgagcagaaaacagaagcaacatatattttaacactttctggttgatgctggcccatcatcatgcttagtgactgtagtgactaaatgtctatggttaaatcagttctgatttccagacatttggtgaacaaaatcagaggtgggagcagcttttcctttattgttatttgtttgattgtgtacttgttgtttctttttgcctccaatacaattaatgtcttcatctttctcagcctactttgacttttcagcagcggacagaacattgtcttatttaggggttactatcgcaacctcattttcaacttttgccctctcttcttctcaggtgcaagagaacttaaccatttagggacccatggatggaattctgtgggtctatgaactgggatttgtatttttactaatatctaactgaaagttagcttttccctcgattaccaatgtaggcaacaaacaacagtattagcaagagttgtgattttatcaccaatagaaatcatattttcctgtaacattacggctgtggctgatatcttgaaatatcatttgtgtgcatcactatttcaaaattacagtagttatgagacccactactgtaacttgttaatgaagcacataaatgactacatcacaaatctttaaaaggtatttcaatattgttcatttccttagtaatcttatatatttaattttatacatttaaagacactgttttgagagggatttactggcttcatcagggggccatagcacaaaaacggttaagaggctctacactgcatttcctataattgcttgttctagaaagtaaggaataacacatttctttttggccaccatgttggcagctttcattcagaaactttcccaagcttgcaaacatttagatcaatgctcttgaagaccattacatcttggttgcatttgtgtaactatagttttttaaaaaaaggaacagtatgtgcaaactctggttttcagccaagccttattctttagggcaccagacctctgggtgtaagataatccatgtattgctctacttgcagctactgttcctgttatttgcagggacagccagaaattgcgatttgggtagctcaccatattgcatttaaccattcttcttcccaggatgacctgtgaactatgtacttgtttagatcaaataaagataatgaaaaacaaaacgaaaactgcccaatgctgagcacagacgaggcaggcacttgcagacccttattagaaaagaaagaggcatggaagacatgtaaatttcatctgatgggggcaattttgctccgtttccctttctcctgattactgaagtgaagggagaagggaggaagattggctcgattgtcaaggaaatgaggtagtttgggtcagctcacgggtaactcaggccctaatgaggtagggtcttaatgagccagatcttcctccttgtcctcttcttaaagggctcttcataggctcattgtcagtttgtctcccatacttatgtacttgtcttctttcccctcattactaacccgcaggaaggtacacttgggcatatatgtcagtgtatgactcacacagaggatttgagatgtgatatacatacacagtttcacttgatttattatcagcagatttagatatgctggccctgaaacatcccaaatctatagagtgaaagagagcctggtagagctcacacatttacaccctccctctctctgtacacacaggggcaacacacacacacacattctttatggccatagccctctacacatctgtgtcacaaacagctgtgacgaaccaaatcttgccacccatcacctacttctgtgagaggtgttacttgtccaagcactcatgtctgtgaggagcatgcatttccaaatgtgctgtgcccctcctctccctcctcctcctccatctctacagatccaaacacacacgcaggtattcataatgcacaggcctaaatgtcgaggtcaggtatcctttgcctcacaggcactgtacagatctgaaagatcccacattgactgcactcaccttgctgtcgctgctgactcaatgaaatggaacttgccctaatttgtttttaattttggtagacatctgagctggcaaaggaagaactcaggtggacccccttgataagacttttctcaacatttgggaatgcagctcccttggctaagctagccagctatatagttacaggaaaggctggggtgtctgctacccacgctttttaaaatgattccccaacaccaaattagccaactgcgcttaagtgattcctatttgactaattgcttttaaggagtctgttaaaacccctcacttactccagcccacactccgtcagacattgcaaaacagcactatggttggggcagtggctgggaagcagctatggttgctaggatggagacagcctggtgtgatggcttgggtgggcccatgttgtttttattattattattttgcaattatgtgagaggagcattatctcatatacttttaaaaaaagaatcccactgtctcatcccttaggtcattcctgtgccatcactccagcaaaactgtgtactctttatttcagtttcaaactcttgtctcccctctccctgccatacacacaaacacacaagtgtgtgtgcacaattctaccatacagttcttcttctttattttatttctgcattttgttttccatgaggaaggcagctagagagtgaaactgaaggatggcttattttctgggtgatagtcacagtaacctacttgaagggttaaactatgcccaaagggagagaagctccctcagaggggttgggggtcggggaaagagagaggaaaaaaaaacagtgagagatagagagacagagaaactgaaaaggaaaaatcccagaggagatttttgaaaagatgatcctgagagcaaatggaggtcaccttccataagcaagactatggcccactgcttcaatgaccacattgtcattgcttcttcactcatccccttctgacagtgtataaaatccagcttttacataagcttctttggctggttttttagtcaacctctttattacacagtgatgcttctgtttcagtccttcagtaattccccaggtccgaaccagtatattacaaagggccaaaggatgggcttgctgtcaccagttatctggtcttttccccatgacaacatctgcatcctgtctgaggtgctgcacccccttgaaactgaccttgacagatgtgttaggacttgtagtgtaggggaatgaccttcagactaacagataagagacctaagttcaattccacctctgctgataactatatgaccttaggcaagtctactcttctctgggccttactttctcatcttttaatagaaatggtggctgggcgcagtggctcatgcctgtaatcccagcactttggaaggctaaattgggtagaaggcttgagctcaggagttcaagaccagcctaggcagctagagatggagaaatcccatctctaccaaaaatacaaaaattaactaggcatcatggtgtccaactgttgtcccagctacttcaggggctgaggtggaaggatggctggaatccagaaagtcaaggctgcagtgagccgagattgcaccactgtactccagcctaggtgacagagtgagaccctgtctcaaaaaaaaaaaaaaaaaaaaaaaaaaaaagaaagaaagaaagaaagaaaggaagaaagaaagaaagaaagaaaaaaagaaacggtaatatctgccttgccaacctcattgctttgttgtgaggctcaactaagatgtcagaaaaccatcctgaaacacaaacagtgctgtgataatatatgtacttgtggtcaacaaaagtcaaggattctgcctcttgtttcaattctgcactctgcggggacttacccaaatctctaagcctcagtttgttcaccattaaatagccattacaatgcccagagggagttgtaagcatttggctggatttttccaaaccacctgttgttctttactgtgggtagctgatgccatgctggggactgaatggtgcctggcatgagagcagggtggaagtggtgtggtgtgccagcaggcagaggctgtggtcacggctgtgaaacattattagctggatgtttccaggttttcctagagagagaaagagaatagaaagaaaattctttaaaaatagaactttaagtgctgtgcaactacatgatattatgttttagtccctctcatttattattcttaactctgtgttggcaccatgttaagttccgtacataccgtatgtcattccatctttgcttcagcccttgagggaagtattaaatagatgagaaaattgaagtttggagagaaagtttaagtaggcttctcaagattagcttgtttagaattggcaaagtcttactccaaagtctaagatcatcttgagagatggataacactagccccaatttacaggtcaggagactgaaacagagaggtaaataactttcacaaagctaaacaagctaaacggccagtcaatggaagagactgatgccaaagcccattcttgttttccctacaatgtaaaatgtggaccttgggctcccagtgtattgctaaatccatcagttcatcagtctctaggcagccatttcctgaaaatgtactgcagggggcttgttgaacacagaccacagtccaattgagacactaggaattacatgaggctaagctcaactgtccaaaatagcagctgagtctattaagtaggtagataggcttgtggccccaacaacagctgtttcctcacacaagcccaaagcacaccattatgtgagaaatggtctaaatgtgttgtaggccttttatgctttgtattagtccattctcgtgctgctatgaagaaatatctgagactgggtaatttattttaaaaaagacgtttaattgactcacagttccacgtggctgggaaggcctcaagaaacttacaatcatggtggaaggcacctcttcacagtgcagcaggagagagaataagagttggacgaagggggaacccccttataaaaccatcagatcttgtgagaactcactctcacgagaacagcataggggaaactgccccccatgatttaattatctccacctggtcctgctcttgacatgtggagattattatatcaaggtgagatttgggtgggcacacagagccaaaccatattagcttattaccaatttctttacagaaatcttgtccaatttatagtaaccacgcatgagagtgcccatttgagactccttgccatcatttagtcccccgattaaaaaacctcttatttgatgggtagaatttatatctgactgttgagtcatttttatgtgttttatcactaggtaaaagttgaatggtttttacatactcattagcaatttacaattcctcctttagatattgtttgaatcttttgcccatttaaccattagagtcttaggttttgtttgtttgtttgtttttgagccagagtctcgctctgtcacccaggcaggagtgcagtggcatgatctctcctcattgcaacctctgcctccgaggttcaagtgattctcccgtcccagcctcccgagcagtcgggattacaggcttgcaccaccatgcccggctagcttttgtatttttaatagggacagagtttcaccatgttggccaagctgatctcaaactgctgacctcaagtgatctgctcacctcagcctctcaaagtgctgggattacagtcatgagccactgcacccagccaagtcttagtatttttcttaacaaatttataagctctttatatatgaaggccatcaaccctctctcatgttgtggtgactattttttaaagcttactgactccctacaaatagtttgaaattgagaggatttccttttgggatttgtttgggttggtgtgaatggcttttttagccttctcacattccttgttcattcaaaaagtggtctctccttggtattgtggctttaccactcaaagaaaagcaagtgtttcagttctgggcagaaatagcatgaatattctcttccatttaattatagagactcagcgtaaccctggcaagaaactaaatcgagcccatcaagtagcagacagtgaagcccaactgtattcctagtatagtgcctgttacatagtacatgctgatgaaaagtttgttgtaaaattaaagcatgcatgaatctctccccaagaaccatgtattatcagttatagcttcatgtctcatcacctcagttatgaggcaaactatcttcttttttctcttgaactcttcattttcaatatttaaaaaacctgattatatcaggaacagggtatctataggtattcatagacctttaacactaataatttccctttcatgaaggggctcataaggttccccaggtttcttgtgaatattatggagaggcttgcaacatagtgattacaatcccaggctttagtgacaaaaagatgagagttcaaatccaattctgcaatttactggctgtttggatgttgacaaattatttgacctccctatgcttcaacctttatatatgtgaaatgaagatgatagtagccccaaactcacagggtaggggtgattctgagggttaagtgaaataatgtatgcaaagcatcaggcatggaataaataagcactcatttaatggtagctacaattattatcaacaacaatgtattatatgttgggggcaggaagcaaggatcaggttagtatcagggactatagcataaagggcattgaatgtgaagtcccaacaaatagattcacgttcaaattctattatcaccctgtgactttggagaagttccttttcttttgtggacctggtactttgacagtaagtgtcctgccatcctctgctcacctgggctgggataccatccccacccttcttacagaagcaatggcttcagcccttgaatctaccttgcagtcaagcatgataaaatcccttctgaggttaagtataatgaggtgtatgggactccaggaagagtaggtactaaggtgggtgcagtttataaggaggtagacaggttttacccagtaaaagagcttttcacagtgtagtggttaaatgcatagtgtcagaagccacattgcccaggtcagaatcctgactctgtcatttactagctgtgttgaccttaggcaagtattttagcctctctgacacttagttttcttacctgtgacatgaggataataatagtatctacatcataggattgttatgaagattaaatctttaatgtttataatttgcttagatcagtatctgacatatgtaaagcacaatataagagttttaaataacaaaatagataaaaataagagctaattaagaattggagggagttctttgatgggtagtgagtttcctttcactctcaggacatcatcagaggctggaggtattaaatatattcaagtaccaagagaggattggacaagataaacttgatcatcacttcctgatcaaaagttctatgacttgctttccaaggtcaccatggcagacttagacccaacttaagccataacttttcagtagatatttttcctcctctgctgctgtcaccctcatttacacttatgttttcttggatgacattttaaaattgatcaatacaattcacaggtatgaagggcagcttaaacctgccacccttcccttgctcacaaagcagctattactttgaaagccagttttactttctgcctttttgtcagatcttagccaaatttgattgacaagaggcttttggtgaaactgtttcattcgtgtgctggatgtcacttgctgacttacagtctcctcatttgtgaggtccctgatgctattaaatgagaggaattatcatgtcataaaaagaatgccatcagctagtcagttttatatctgacctagctgtacttgcatctgccatttgactttagcctcttatttgggcagagaatagcatccattcatccaccctccaccacctgtcactctcactaaagaccagaagaagtctgcctccaggtgaggtttctcagtgatggactgatagaaagagtgctggagttactctaagctcagcagaccaggctaatgctttaatagaccatgtagacaaagggcagtgaaagaactagggcagaaatgattttttacttggagaatcagactagattgtagcccacacagatgcagcctcctgaatgattggaggagtttcagtattcccagccccgccctaggctgaaatccaaaccgggaaggcaaggcaaggtgtgagcacataggtgaaggaatttccctcaagcagaggcccaagctcagaaggggtcctgtgaggcacataattcctagggtcttggctgaggcaagtctgccaaccctgaaaagccaggggatttcctgcatgttagagaatggctgaggccctggagtattttaaccactctgggaaaagtagatggagcaaaaaaaaaaaaaaaaaaagaagaatcaaaaagaaagaaagaaaaaaaaatgtctccaagacaccatcagagaagtagaaggtggaggtttccctgaagaagaagactcaacctggttccagagagactgccactcagcaactgcaagtatggccttggaatcggagagacttgggttcatgtcctggcttagccaagttccaccgaatgagttacttaaactcaccaagcttcgatttccccttctctaaattacagatactaataaaagcccctgattcattgggttgttgtgacaattacattatacagaatgtaggtaaagcacttagcactcttggcaaaaactaagtgcccagtaaatattaactattttaatcattatcatcataatgcatcaattactggaaacagacaaatataactttaagaaaatatagatacattttatatacttttcaatgcatactatatttcctaataaaaccactatttaaaaaaggaaaaagaaaagcagtatgacagagtggttaagaatgtatgacaaatcatggttcacactcccagcttgaccacctatccctgtgagtgtctaggtaaatcacttggcctcttgaggctcataggaccaaccgtgcaggatattgtcagaattaaataaggaaacccccataaagtgtttagtatagtgcccttcacagaacaaactaagatttatttctagttattatcattatgggttttcctctgcaactctcagccctcttgtgttccacttgattctaccagtctttagcccattattacaagctgtaccagagggaagttcagagtaacactggcggtttcctgggtgggggtagtcgagattgaaactatcaggccctagggtataatccagtggtagtgaaatggggtaaagcattgttaggaacccagcctattaactaaaggcactgtggctttaaaaggtaattgttttccagtggcctcccagagctgagtcagttcctcagtggaccctgtatcacgatatagctcctttcttccagcccccatcacagcagccaattcaacacatacactcctggctgacgcatttgccactttcttcaaatatttgctaaaagcttcccaaagcaggaagccttgcggttgcagagcattctctgagagaaatgaagcaatggtttctatggcaacactttggcacttattagtgtttgcgtaggcactgaggcaaaagctggggtccagacaagcccttgctgggaagggatgaggagaagagagggcttgggatgcaaaattgctctcactttgccctcttggtagtccttagggacagtcctgggggagtgtttggggcacaatttggccatatagagacagtctgaactctcctggggcagagattgcctcactcagtaccacctgtctttgccaccaggtttagcttccccaaacactccttcactgtgccacccctctgcccaaaagctttgcttcttttccccagtatctatagatcaagtgcaaatcatggcatttgtggccttccacagactccttttttcagaagctgtagctgcctccctcactgtaccccctgtgccttctacttcagcaagatggttcaacctcatcctacctccactccctgttacactgcaggtgtttctacttcccacctctcttccataccattctccttgcttggacttcctgataccatcgcccatgtatccaggacttgcctttccttcaagacctgtcttaagcctcagtttcttcaataaactttattggaccaccccaactcagtggaattccattctctgaattgagattgtattactactcagatctgtcatgcatttgacacttaaacacacactgccttgtatgttgttttattactgcatatatatacttttttatatatgtgtgtctttattactgcatatatatttctttattactgcatatatatgtgtctctattcaacaaatagatgtctctgtctagacagtaagcttctccccaaaaggggacttttaaagtgtttttctgtttttccacagtgccctgctcataataagaaattaattagacattatatgcacagggtttaacccggtgcctggtatatagtaagtgctggagagatgtgtggtaccctcgaatagttcttgattgataccctgtacctccattgccacttccactcatgggctgcatatggtgtccctggacattcatttagccttagccttggagccttcatgagccattaggttggcaaaactcagtgagtgaccattggtcttatccacaccatctcctgctgcccacccactcaccactgcagccctcaggacaggctgtgtcatttttagagcccagtgaaaaacagaaatgtgaggcctcttgctgaaatagttaatttcaagacagtgagagtagagcattaaaccaaggatagggctcttcagagttggggccctgtaccacggcacaggctatgttgcacacccacaaggccagccctgctcgccatcctacttttcttgtgccgtgttccaagttcctggcacaagagacaggggaaatccacatgcggcaaccacatatcaaatggctctagactaactgaccaaaatccaatgatccaaaagtgaattcattgaatggccaagtgtccaaaaaacaaatttgtgatgtctgtcttttattttgccctgcccttgcctttgcccaggctctgcccatgcctctgcctgtgcctacatctacactttcatcttctcacttcccaggtcttagcaaattaaactataaaggcaaggctgcatctgttttatgtccctttcccctcatgttctgatttcttttgaatcagtcatgatttctttgggggctgaggtgagcagccacatgaccactccatacttcactcacgggacagccagacagtagagattagtaaacattcaagagttaaaagctgaaggccaggggtggtggctcacgcctgtaatcccagcacttttgtgaggctgaggagggagaatcacttgagcccaggagttcgagactagcctgggcaacatagcaacaccctgtctctacaaaaaaaaatgtaaaagattagccaggtgtgatggcacacacctgtagtccaagccattcaggcagctgaggcaggaggattgctagagcccaggagtttgaggctgcagtgagttatgattgtgccactacattccagcctgggtgatagaatgagaccctgtctcaaaaaaaaaaaaaaaaattaaaagctgtaagcagaggatgtcatagtcttaaaatcatacttttaccctgctcatggataatataaaactgtaggacagtctcactccgtttcttcaaacacagtaagcatcattttatagtctgtctctggtatgtccaacatctgaagtctttgagggtctgtttctgctgtttgctctttctttagactcctggtcatggtctcttatttccttgtgtgtctggttatcttcatgtgctagttgttgtatttgaaaaactatttgtagtagtgatttgaagcccagaataaagttatctttcttcagagagagaatttgtatttgctttagtgagaatcctgaggcattgctagtctggagtaaatttaagtttactaattaagttttcctagacagtataaatgcaatctgctgctccccaaggttcatatgtggtttacccttattctgcaggtataatcatttggagccctagttttctgtggggagcatttcctagcagacttctcaccttctattggatctggactatgatttctgtccctcttgacccacaaggttttcaatattaaagttgaaattttctggcatggaaaaatgcccttagagtgaaagcagctacatccatgcttactcatctctttaggttctcactatcacttcatttttgcctaacaatacttaaataccttgttagtagttctttattgattttaagaagatttttaaaaaacagattttctgatttccggtggcttcaaccattataagaaacccaaagtatgtcacatgcaattctctcatcatgctttgaagtaggcaggtagactgggaggctaaaactatacatattttgtagatgggaaaattccatgaagttacttgcccagagccagacagtgaattagtgacagatcttgaaagagaaatcaggccccacatgttaccatcacattctcaaatgatgaagaagtattatttcccctacttatgccaaatgctgggaggatggcctttggttgctcctacttttccttccatcttctgtcatcattttatagtctgtcttctcccaaggggaaaccttgctttgttcatttggtctttgtaggagacccctagaaaaagagttggcaacttttgcaaagcagtggtgtcaagattcctggtcttctcctttcctttattcccaagtaccctggtcactcctgggatgttgctttagaaacagggagagggatgtggcagtggggcctgatcaacagcaaacacaggtgccttcttggctatggtggtggcctaattaccatgaatgatcaacgaggtctcctctgccgtctgccattgtctcccatcttctagtagcagtccctcaggtgcagctttagagaagctacataccagcattctggaagtgcttttacgcatgagtgttaatttttccatctgtcctgtcatctgtgactaccagaagttgatcttggaatgtgtttaagcaggttagtggaataaaaactccaagaaaacctgacattttggaattgcccatctaagctggatcattgaaattgtgaaccagagccttttagggaaggggttggcataagaaactcagaaatggctgggagatgaaagtttcaggctatatgacctatgacatgaaagcttacagtggtatacacagcctctgcaagagaagcccaatggacagacatcccagttacagacctctccagaccttttctcctccccaaatgaaattgacttccatcttagagcttaggtactgttagctattcttcccaagtatccttgacagatgctacaggtataatcaggtacaggtgtctgtctggaaagatgccaataagggcaagcaattggaaaggtgcccaaaatgtatacaaaattaacttggatgtcaatttgaacgtgctaaggtggtttgacacaagtgaaaggcagaaccatgctactaacactttccactatgttatgggcagatattgccaggttgccagaattatgtcatatttttattttcaacagttatattttctggcattttgagcacagcatttctattgatatttgagagggattgtggataatttagcatatggttatgggtttctttttcatttaaataagagatttcactaagcttgctatctccctgtatgtgatgtgattgcactcactgtctgatgttctgatgtttttttccccaggataaggagaaggaagctaataggaaagtttataaaggaaggcaattaaaaagttggatttatgaaatagaagttggatctattctgttaagtaaaggatgcatgtcttgccaacagtcatgcctagtcatatacctccagcaatagaggctctgttgtcctgagcaacattattatcttcttctaggaagttatggtctcagaattctaggaaactgcttccatggctgatttcactccaccacacctgccgtttccatggaccatggcgaggctaagctgtgggtcagtcaataaccctcagctgcattgctgatgttggtctggggctccattggacagaaaatgtttgacactgatcacctctatttgaccctgcttctgagctattgtttctgccatttccccactaattccaggtaacctagccttctcatttactgatctaagtttcactctgtaatctcatctcttattgttaacaagagccacctggctatcctccttaactgggagcgagaggagagcctcgtctgctgctgggcagagaaacttgtatgggggctgaggctgggaaaggcaagtaaggtcattttctgagtgcttactatttgctgggcactgtgctgggtgctttacacatgttaactctactcatttgctgtcagcgaaaggaagggtagaaaaggctcaaccctaaaggatgagaggctgaatttgtgttgttgttgttgtttgtttgtttgtttacaatagatggaatggtattgtgtaagggagggcttactccacaaagattaaggagcctatggtcaaacaagagtatgacttaaaacaagtcattttcctttactgagtttcagtttacccccctgtaaaatggccacatagtctttgctcagcttaccatatatacttgttgtgaggatacaagtgatatagaatgcttagaaaagtataaaataaaatattgcataatgtcatgtgaggcaatatagaatagtagttaagaaccagactacagatggggtgtaggattgcaaatctcagcccagcaacttgctacctatgtaacctcggacaagtcacttaacctctatatgccttagtttcaacatctgtaatgtgaggatatgaatagtacctgttcatggggtttttgtaaggaaaaataagatagtatgtgcaaaacattcagaatagtactagcacatgataaatgctgcataagaactgtttattattacaaataatagataactatgaatattttaggcccctatctttcccacatgcactctctcagtgttgtaacccttaatgcaacagaacttggctaatgctgcaagtcccgttatattgtacatagctctctgcatgccagggcacataaccctgccgtagaacacacataggccatagcacttggctatataaggaggtgggagctcagtactcccagtggatgagagaaaggcctctgtaaaactggatggcctctgaggtaaatgccataaaggattcatttacataaattcagaatgcttcttaacttttcagaaacatgtttcctgcattaagtgagatatatctgtatatagaggaagctgcagagttatagcatccctctacaacatttattgagagacaaagaggactaatgcgtgaggatgtgtgagataaaaagaagactaagacatagtccccaaccttagagagttgatcatttagtaggggagataagacatatagtcaagctcaacatgttgtaagacagaaccgtgttatcagagtaaatgagaacatacatatatcctttataagctgggaagactatataaatgccaatggttttaggttttttttttttaaacaagccttaagaattgcaaagtgctgtaggagatagagaagaaaggaaccatttcttactgggggcatcatggaaagcactgaagcatgagtagtctttcaacaggtagaactgagggcaaagggcaccagcaaagccctgcagatgagaactcactcaggatatgaagggaccagtaagtagcttgtgtcggcttccgcatagaatacacacaggagtcttcctgaaggatgacaaagctggaaagtttggctggaactgggcttaaataccaggctacggagttgggcttatttaggaggccatggggaattttagagcaggggaattgcatcattcaaacttcccttttggaagtcactctgacagcaggaagtgccatctcctctggccgcctgaaggacttttctcctgcaatgctatctctttctcttctgcatcatcaatctttctccagagatatgcagtggcagcctgctgctttcaaaaaacaaacaaatgaaaatcttttttggctgcatactctctttctatttctctacagccctgatagcacactgtctagaaaaaaaagtctatactccttgtttccacttcctcgcttatcaatctcttctcaacttgctttagacaagcatctacccccaggtatatcattgtcaatatcctcatatttttgtgaaggtcactagtgacctccatggagtcacatccaacagtcctttttctgcaatactcttttctcttgattttccaaactcagtactcttccagctttcctcatctctctctagccattccttctcagtctcctttgttgactatttcttctctatgtcatctctaattgttggcacacccgacggctcagttctagatcctcaacttctctttatcagtactcttatttaaagtgattttatccagttccatactttaaaaaaagtctgcctgttgatgatgctcatattcatatcttcagctctcacctctccactgagcttcaaacttatatattctcctatctacctaacatctccacttaggggtctaatagcatctcaaattttatcatggccaaaaacaccctcttgatctgtgcacttaccacatctgcaccaaattatttctactgcaggcttccccttataagtaaatggtaccatttgtccaagaccataacctaagcctcattcttgatcctattttctcccacccaacacatcctcttcatctatctattaacaagttctattggctccccctcaaaaacgtataaaaatccatccatgttgtctatctccactgctcccacctggcccaagccaccaccatcttttgcctagaccactacaattgtctcttaactggtttgcacacttctactcttgctcttctatatttttactactaattatggggcctacagtgaattcttcacaaaaccttcaaagtgaggttttaaaaacataaatcagatcatgtcactcatctgcttgaaaccatccaatagcttcctgttgcaattaaaattcaaactccttccgatggtttacaagggccctgcgggatttggccactgcatgtctcttcagcctcatcttgtgccacactccctcttgctcactatgttttagtcttactgtctttctgttctgttaacaagccaattaaggcctctgcactgctcttttctcttcttggaatgttcttcccctagatctttacatgtgacaggcttcttcttgccctttaggtctcagcatagatgtcacttcacctcagaaagagttttcttcaccatgtaaagtagcctcccttccttgccatcacttcctaatacatcagcctgttttattattgttatagtatttatttatgtcaaatcatcttatttatgtgtttattacccaatccccacacacaactaggatgtaagcaccattagagcaggaaccttttctgtcctattcacccttgtatctcccatgcctggaacagtgcctggtatgtagtagacacacaataaatatatattgagtgaatgtggcataaattaattagcagcagagtggttactgcagtgatacaaacaacaatcaataaaggttttaattaaattggtggtagtagtaagtgagatgaaggaggaaaaatcagtattagactaatcccacccaaattgcatttaaaggcatttaatacagaaaatttatcctaagtcactatttctagtacagagtatcaaaactaggaccacaaatcaattaagcaataaataattatccattcattaaccaaaaaaagaaatgaaagaataagtcagtggaacttggtgtataggagtagaaagaagaatgatgattccatagtttcttgccattagaacaaaataggaaatttgagagaaaaactgctggtaggtgggagggaagaatgacaggtttggtatagaacatgctgatttttactcatcctctgaggcgtctgggagactgcctcagtgtgagtttagaattctacaggaaggactgaggagaagatagagattaggtacataatcagcatagccatgagagttcaaagcaataggagtgggattccttgaggaataaaaatcaactgaaggggataggaaatctttatttcaagggatctgtctatcacatttcttagctcccaggaagtataactagaaatgtggattataataatttccattttccccaggcacttccccacagttcactccctctcttgaataactctgtggatgttttttcccaggtagggggttcctggtatgggctgtgaggaagcaccgtgatcctttttgccatcagcccccatatttatgcctctcactactaacagggacagatatcaagataagcaatggagaatgcctctaaaagattttgtggtcttttgggggaaaaagcctagctataaagaaagttatcacttctattttgctttttccaatgcaaatacacagtctgatcccttaaataccagaagcgatgctgtcagcagcaacaacttaaaaaaagttcaccccgatatgtaaagctttttttgtaaatcagacttgctccctaatgctgtcagttgaagaactgcccttataatttttactcactgccaacctgtgccttgccaagatgaaggagctcatctgagttagtagtagaactgggttgagaccctcagacttctaggcccagcccttcacctcacgagcagctgttggcagcaatctcagattgttattctaccctctttctttgcttcatcttgaacccttggtgggagccaaaagcctatcagagactgattgttctgctgctgttggcagattggcaccagccagtttcaatgcttgtgcaaagagcatataataggtccctaatgagggcaagacaatgagtgtttggttttgattgcagggcttatttgtcgtgtgtctgtgtctatatctagtccctacaaagcaaacctgttggtgggacagggcaggcaggagaggaggaggctgtgaaatagagactcaaaggacaaagtggcaagtggtccaaggctctgcagtggttcatagctataggaaatggaacctagaacttagtcctgtgccttgggccttgggcttgagcagaagagagaggagtgggtttgggtggtcacagtgggctgttatattctgaacaagacagaacagtctgaatttgggttctggaaaaggaatcaactcctgttgggggaaaaaagtaagctctattggagcagtaactttgtttgtcttcttcacctctgtatccccagggtctagaaaaatgcctggccatagtacctctacaataaatatttgttgaatatgaatatgaatttttttctgaatagaaatctcgagtctttgagattttattgattaactcagcttgtctagcggaagcctttccctggctttcactggaagaatttaatttgtgtaacagtccaggcaataagccaaaaccccacagagattgctttttagaattgctcttgtgcccatttgctttattttcgctttcctctagacctggtcttccatattgaacatttcgagatgttttttctcctgagctaataatctccataagctcccatttttcttgccccatcactgggttgctgatacaatctgaacctctgataactgagatttccatttgcttgctgatctctccttagtacagtgggccttatgaacaacgtgtgttaccgtgtgtgtgtctgtgtgtgtgtgtgtgtgtgtgtaagcaatcagaactgcctggaaaaatgaaaataagtaaagagggcaatggaaggtgatgattcacacataagtgaaatgattagatacttctcagcctgtcactagagtcttatgaatactagacaggaagatacctttgttaagtaccaaatctcaaattggccctaaaatggagctctccagttcaagggaatggttgatcttccaaaaacaggcagatggtgaatccactaactcttataatctccaaggtcattgtaaagtaggaaaccgggaagcctggaagataagtaggcccatggctgtaaataaggcttccagttggcctgtgaggaggactttgggaacagcagctactatccatccttggccctgcctgagcctagctcctcatgctgcctaattcagaaactatagccatgtactcccagtccctctctcagcttctcccaccatctccagaaactgctgagggagggaaaattaacattaagttagaaccagcaagcattgaagaagcaggcaagcatcagaggtgaggaacaacctataagtcaataacaggagagtgagtcttttaggacaaaccttggaatgttgaccagagtctcaagaaaatgttttacgtagctgtgtgcttaaaaataactgagtttttgtcatagataatacaaatagtcaaaatttcatcctttagtccctctacctcgtggtgttaataataatgacagccaacatttattgagtgcttactatgtgccagacactgtcttaagcaccttatgcacatcatctcacaacttcatttaattgccacaacaattcccatggtgggggtgggtacaattactgttacttccagtttataaatgataaagcagaggttcagagtagtgaatgagttttcctgattcatacagctactgagtgatagagaaaggatttgaagcaaggttctctaacctcagaaccacatctgttaaccaatacactgtaataggtcttttccttcctttgactctttttgcttaaaccacaattgtataaagacttaagttgatgcaatagcaatggaagtgaaaaatattgtaagtgttttgtcttctttcatggaacaatgggtttagtagctgccatacccctttaaccatgtcagaaaagcatgaaaaaacagcatatattggtgtatcatataccgttattaaataataagccatattatatatgttattaaactatgaacagacagcagtagattttactgtggaaacttttgatagacgcacagcacaagtatctcataagcacaattttattagattcacatgtttattctgagatctgtgacatattcaggaatatacctcctgtgtaactgaggtaaagggtttctgaagccaggccttcttgtattttttcttccaggagggaactgaggttatagataggtgtatactccaagtacacttgatagagtgagctgtgccaggttgaggaatgagtttccattactggcttaggagggggtgaaagtgggggccacagaaggttctgaagcttgaggtgcacaatgctttttgtcagcttgctaccagtgtcagtgcaaatggggaaaggcttgatgtcttccaggacacaagactatttaagcttaacatcccaggaacatattcaatactgtccagagacttctctttctttatctgaacagatatttaatgatagaaaggtgtaggccagtgagtagtcaacaataggcaacgattctagagtactgactccctatgtactataattggctgtaatttgctcaaagattcattctaggcgcaggcactttctacatactccataccattaggcaggatcttgccaagatggagaccttcggacctgtctacatacagtggggtagctgtctgcccaactatgaccctcatgattatgccataccacactggacagctcccatccagcccggagctctttcctctttccttgacacatccctcagggcccttatccactgaatagcatgagcccagacagcacctcctcagaccaggttcacaccaccatactccaaggcaaccctccaggcacttatccatgctcctaataccaataaacagcctttgctcacaagagaagctatatcctaattgtgcatgtagtaagagctttcttgttaagatcacacattagctgtgatacacactgagacaagtctgctttccactagagtctaccttgcaattacacaatctggatactggcctttgtggcctacccagccactctttactcagtgaggcaacccttgtgcagattagagctctcagtggactctccaatacaacgaagcaggccctaccatcctgcccctctgcatgttgtgtccatccccaccaccagccaccacttcccacaagacaatcagcccagagactttaattgctgggtctgctgtgaggctggcctcaccagctctcaccttcactgcagcttatacggctgttttgctcacagaaaggcaaccatctccagaggaggatccacatctcaccatatgcccagtgaagccactttccagtgcccctagtcagtgctgcattatccagaaggccagataagtatgtgcttagagaataacactgtgggggcaccaatcaaatgatttttaaaagagttagaaatttgatatttaaaaagctgaagtagataagaaaaatcagagctgtgttggatttttttgtcatctgttgtatggcttataattgtttccatgtgaattacagagaggaaggtagacacaaaaatgttttcattaattagggcttccaaaggccctattttggccctgccctctttgtttctccatacactgtgagccagccatctgctaccatccaaaattcctcatgctattcctggaatagtaatcctaccacaaggaacaatatctattcagaatataccagtaaggtcacatcaggtgttaaaatattgaaatacttccatatctattgacgaagagccattgccctgatcccttcctctgcaaaccccctgcctccaccatcacctcagctgcactagactctccctaaggatctccgggcccccttataatctaacaactgaaggcataatacttgctccagcatcctgtttcaatgtttatactgattggtcagtgtccatgcagaatctgctgttaaatattttgaatatcaaatataggaaaggtcctataactgctgcaccaagcattatacagctttctggggctcactacttacatgcatatgtcacttggcaaatctcttccaaaccagagaggatttctgaacacttggtgcacattgtacaccaaccactagaccacactaccattccctatatttacatggactctttgccttgaggcaatctctgaataggcagcacctcagctgagctcttcatgaggaagtcctccagatacttaccaatcctgcacaccatgaggaaggttttaactctgcctcctcttcatttattgacttgacctgccattccctacttcccctataccttggcaacccatgatctggccattgcacattgcttcaaaacaaggaaatgactgacaagactaggtccacataggcaataccagtccttgcaaactgagacaaccaacctatgaccccgtaagagtccacatggaacatagtgtgttggctcctaatgtgggtcccacatcaactcttcacagagcatttggcaaaacttgaaaccaagatctgtaatacaatttccaacaattcaatggactttctaaatagtcaagtccaaaatcccttcttccccaggaacaattctctagctgtgtcaagcctgtgaaaccactcaggacactgactggagcagaaccacacctacttttcacacagcctgagctaatctctaaccagaacaggatctacatcaaccatcaacgctgaccaggcaatcatatacacagccactcctcatggcctgaaacaaaccctaactaggccagggagcaaacatcagtctgcaaaacttgaggcaaattctgagcagaacagaatcttgaaggagctgctaagatgactctagtccacagaagcagcctccatttcatgaaacagcctatgaacagaccaggcatatggtcccatgcctcacattcatctcctccctttccctcctcttccctctttctgcccctttcttctttcccattttctcccattccttgaccctgttattccctttctctctcacccaattcactgccatattatttagttgttataataattttgatctccctagtcacagggaggggaaaatctaggaaacttctaagatagttccagccccccaggcaagtctgctgttgaaagactgggcctactgtatgagaatcagtgcatggagtttatgttcctggaaccagaatggttgtggaacaaaaacctcttttctagtaagcaagcccccaagccagctgttatgatctgagaccagtccccaagtgaaaggctcaggttcagccagattgggagggaccagaggagactctgggtaaaaaagtcaagtagataaactcttccatacctcctgctattccaagttttggtctgccacattaggataaatatttgcttaaaaaatccctcatgtgtatgtttgttgtcaagcttttgcattagatactacacaaactataattcattgtccctcatgttccttgaacccatttctgcccaattctctccttttatcacattccttaagaccttttaattcatgtttatgtacatatataggaacctacacagagtactatttgtgtatggttttttaaatatatgctatgcagtacatatcattttgcaacttgatttttcactaggcattgtcttgaagatcttgtcatatacatatagacctagttcatttacataaattgctacataatgtggcatatgtaatcactctatgtaattattcctttcttaatggacatttaagttgtttccaatgttttgctattacacatagtgattccgtgaaagccttagtttctgcttccttgtgtaattgaactggagtttttctagagtagatactaagaatggaaatttctgggtcatagtgaatgtcccccctttttttactttaatagatactgcaaattgtactctcaagtggctttctgtatttacattccaataaagtgtgtaaacatgcatgtttcctcaatcctttgcatgcattttttcaagtttttattttgaaaaatttcaaacataaaattacacatctgacaaaggactaatatccagaatctacaaggaactcaaacgaatctgcaagaaaaaaacaaacaatcccatcaaaaagtgggcaaaggacatgaacagacatttctcaaaaggagatgtacaaatggccaacaaacatcaaaaaatgctcaacatcactaatcatcagggaaatgcaaactaaaaccatgatgaggtaccaccttactccttcaagaatggccatgattcaaaagtcaaaaaataaaaaaatataatttacaatgcatatccatatgatcaccacctagattcaataattaaggttccatgtctgttttatctacctatcttttttgatgaaccatttcaatgtaagttgtaaatatcatgattcgtgacccttaaatactttagcaagcctctaaaaataaggacattctcttacataaatgccagttattttcacacaatatcttatcatacctacaaaaattaacaataatttcctaatccttatatcatttaatatccagttaacattcaaatttcctcaggtgtcatcaattgtcttttttaatgttttattttgacagccaggatccagtcaagtttaactaattgcattttttaatggagatattattaacatactaaagagttcaccatttaaaatagaacaattcagtggtttttaatatattcactagattgtgcaaccatcatcactaattccagaacattttcattgccctgaaaaggaagcttgcacccattagcagtcactccccgctctcccctactcctggtcaccagcaaccactaatttactttctgcctttatagatttgcctattctggacaattcataaaaatggaatcatatagtatgtgccctttcatatctggcttcttttgcttagccatactgttctcaagattcatccacattgtagcatgtatcagtacttcctttttaaatagccaaataatattccattgtatggatataccacattttggtgattcatgcaacatttgatggacatttgggttgtttctaatttttggtttttatgagtaatgctcctatgaatattcctatacaagtttttgtgtgggcgtgtgttttcatttcacttgggtatatacctaggagtgaaattgttcagtcatatagtgactctatgtttaacattttgaagaacagttgaactgtttctgcaatggttgccccatttacattacaaccagaaacgtatgagggttacaatttctccaaatactcatcaacacttgttattgtctatttttttgtgtgtgttagagccatgttagtgggcatgagacggtatcttattgtggctttgatttcaatttccctgatgattaataatgttgaatatctttttgtagtttttcaccatttgtatatcttcattgaagaaatgttcattcagatatttgccatttttaattgtgttatctttcttatggagttgtaagtgttccttatatattctagataaaagtgcttcaggagatttacgatttacaaatattttcttccattctgtgggttgtcttttcatttcttgatagtgccctttgacacacacccaaaaaaagtaattcaacttattgagtttttttctttggttgctttcacttttggcatcatatttaagaaaatgatgcctagtccaaacacaaaatattgacccctatattttcttctgagtttcattgttttagctattacatttaggtctttgaccatttcaagtaaagttttgtatataagacagtggtcaaaatttattcttttgcatgtggatatccagttgtctcagtaccatttgttgaagaaactgcttttctcctttgaatggtcttggactctcaattctgttccattgactgacatagctatctatccttatgccacttggttactgtcactttgtagtaagttctgaaactgggaattatgagtcttcattttagatctttttcaagattgttttgcctatcacgaggccctggtatttccatatgaattttaggatcaacttttccttttttttttttttttttgaaaaaaaaggccattggaggcttttgtttgcttgtttgttatgtttttgatacagggtatcactttgtcaccgaggctggagtgcagttgttcactgcagcctttaactcctgggttcaagtgaccttccacttcagcctcccaagtatctagaactacaggtgtgtaacaccatgcctggctaattattattatttttttgtaatttttttgtagagacagagtctcacaatgttgtcctggctggtcttgaactcctggcctcaagtgatcctcctgctttgacctcccaaagtgctgggattacaggcatgagccactgcacctagttaaaaaagagcattagagttttgatggggattgcatcgcatctataggtcaatttgaagagtgttgccatgttaatgttaaaccttccaatccatgaacataggatgtcttttcacttatttaggttttctttaatttcttccaacaacgttttattgttttttttgtgtacaactcttgcactcctttgcttaaagttattcccatgtattttataatttttgataccattataaaagaaaatgatttattaatttcattttctgattgtttattgctaattcatagaaatataattgtttttctgctaatcttatatcctgcaaccttgctgaacttatttgtctaacagttttttagtgaattcctcaagattttctatatacaagattatgttattcgtcaatagaaatagttttacttctttctttccaatctggataccctttatttgtttttctggcctaattgctatggccagaatcctcagtacaatgtttaataagagtggtgagagtagacattcatgttttgtttctgatcttaaggagaaactttcagtcttccattattaagtatgatgttagctgtgagtttttcatcggtgtgcttcatcagattgaggaactttccttccctctcttgtttgttgaattttttttatcatggaggaatgttggtctttttcaaatgctttttctgtatctattgagataatgtggggttttcccctttattcaactaatgtgatgtattacattaattgattttcgtatgttgaatcaatcttgtattcctgaaattaatgccacttggtcatggtgtatattcctttttataagctgcaggatttaatttgctactattttgttgaggatttctacatctctatttataaagaatactggtctatcattttcttttcttgtgatgtctgtctggttttggtatcagagagatactggcctcacggactgggttaggaagcgttccctcctcttctggttttggaggagtttgtgaatgagtagtgttaactctttaaatgttttgtagaattcaccagtgaagacttcttgtcctgggcttttttttaattgttaattcgatatttttatataagtgtgttcagatttataatttcttcttatgtcaacttgatcttctgtgtaattcattgcattttgttatgtctctttagaatcttatgccacaacaatactcccacattttccaccccaggacattgacttttaaagacatcaggttgccttgtagaccgtcttgcattctggatttgtctgattgtttcatcaagctgtcatttaacatgttctttgctttgtatttactataacctgaaagttacatataatgtcttgagcagagtcaaatttaacatttttattgccaatacttgatttttttaaaaaaaattacattttgaaaattgatagatgaaggtgagagctcatggttaattagtggtaaaattgaatagatttttagacttattggccatttgggtttcttattccgtgaactgttggcttttattctttgcctatcttgctattgtgttgatcatctttgtcttattgatttgaaggtgtttattattatattctagataaaaatcttatccacatttttcatttacttcttcaattcacctgaaatttatttttgcaaatggtatattttaggcaagaatgttatttatttaaatgtattttttaacttatttaaatcaattttatctattgtccagataaaatgtattgaatagtcgggcttttcattgacttgagatgtcacttttattatatactaaattcccatatatacatgaatcagtactttttattatgccctattgatttatttttgtctagtcatgtgaatacattttaattacacaatgtataatatgctttgatatctgtaaggggaagtatctcatatatttttaaaattgtcttggctattcttgtacattcacttttcttttgaattttagagttcgcttgtcaaaccttaggaaatatcttttttattatgtagattgtcattgcattcatcttataagattacttttgtgagaatttatatccttaacataatgagtcttccatccataaacaggccctttttcatgttgttcagtacatttttgtagttttctccgtaaaaactttaaccatttttggtcagatttattcctatttatttcagagcttttttgctgttataaatgatatttgcttttctattacattttccaattggttattattggtgtataggtaaactattaattttgctttgtgaaccttatactcagtcacttgttttttttttagagacagggtcttgctttgttgcccaggctagaatactgtggcacaatcacggctcactgcagccttgacctcttgagctcaagggatccacctgcctcagcctcccgagtagctgggactacaggcacccaccataacacccagttaattttttaaattttttttgtagagacagggtctcgctatgttgtcccagctgaacttgaacttctgggctcaactggtcctcctgccttggcctctcaaattgttgggattacagctacgaggagtcaccacactgagctcccagtcacttttaacaatgcactaagctctaaataatttgtcacttcatttttaaacctattttttctctctcattgcattggctaggatatctagtaccactggaatagtaattgttaatgatcacccctttcttctatttcattttaatgagaatgtttctaaattttcatgattaaagtaggtttgctgtaggtttctagtagataagtttatgaagataagttggtcctaatttactagaagatttgttaaacgtgaatgtatggtatactgtgtgtggtacgtacaaacttgagaccaaataccacatttattagaaaataattcataggcagcatgggcccctgggctgaagagcactggcctcagttggactgaactctgagaagatggaatctgccaattgaagccagacatctgtagaatctagaagtgaagaatttcccagagagaggtctctgggtataccatacaacctcaggcttaccaggaagtagcatcttgcttgcaagaagagaggaagaaagggctggcctggagggcgtccaggctcagcagatcatattcctactacagactgttgcctgcccacctgcctgcctgcctacctgccttaggttatgaagccaattaggaacagaagaggataaagaactgtgatttgttccactttccaactctccattaaactgtagaacccatgggtaaggaaattactttttttttttttttctgcctcagaagacaaagagcattcccttggagattgtcatcttgtttttatggaagccactacctagagttgaatagctttcccctttccatgctatactgtcagcagtgccacatgacatcttcaactactgctacctaaaaaaaaactcttacttcctaccctagcctggaataaccagtggctgaagccaaatgcctaagaggtgctttcctcaaaagaatctctgtctcccacacttctgggaaataggtggaaagcagaatgaaacaaagtgttccttagtccagttgtagtcaaatggaagaactgaatatttatagacctggatttcttatactagccccttccctcacttgctgtgtgagttgggccaaatcacctaaactctctgtgcctcagtgggagagaggacaaaaatactatctaccccaaaattcattgcaatgattgaagaagatttgtataaaatgcttagcaaagagtctagcaatttaagagttcacaaaatattatttgttaaaatgcaaatgaatgagattgtgagaatgctcagagagtgacagggaagaagagccccatcttattccatatctatctatctccagtgacatgcaagcagatactaagttatctaaatctaactaaagagaacaaagattccccacagataccttcagtagccccatgctttggattcaaccatctctttttatagggaagggcagacacatgaaactgggcattcattgcaaaagcaatgactccttcgagaccagcctggccaacatggtgaaaccctgtctctactaaaaatacaaaaattagctgggtgcagtgggggtcacctgtaagctacttgctaggctgaggcaggataattgcttgaaccctataggagaaggttacagtaagccgagattgcgccactgcactccagcctgggtgacagagactgtctcgaaaaaaaaaaaaaaaaatcaatgactccttaaacatggaaagaagctctatattcctcaatattgaggccgctgaagaaaaataatcaatggatacctctactgctcaagaaagctggactccaagactaacttgattcaacccctgaataactacaaaattatcctggtttcccagggattttattagcaagaggaacagaacaatcaagactgatctagactacagacccctttgtgtaccctgagctatgctactctgtttactaatatgaacatcagaatgccttgattgcttaaaggagaaactaggtgttatgtataatttgggctctgacatgctcctactttagacgaataatttcttatttgaagaaagaggatgatactgcgaatcatatatctttccacaggactcgttgaggaagaaaaggagatcattttatttatttacttattttttattatttttaagaattttaacttttattttagattctgggggtacatgtgcaggtttgttatctgggtatattctgtgatgttgaggttttgggtacatttgatctcatcacccaggtagtgagcatagtaccaaatagttgtccaacccttgtgcccctccctccctccctccccctctagtagtccctagtgtctattgctgccatctttatatccatgaatacctaatgttcagctcccacttataagtaaaacctgtggtatttggttttctattcctgaattaattcaattaaataatggtctccagctgcatccatgttgctgcaaaggacatgatttcattcttttatatggctacatggtattctatggtgtatatgtatcacattttctttatccaatccaccattgatgggcaccttggttgattccaagtctttgctattgtgaattgtgctgtgatgaacatacaagtgcatgtgtctttttggcaaaacagttattttcttttggatatatacccagtaatgggagtgctgggttgaatggtagttctgttttaagttctttgagaaatcttcagactgctttctgcagtggctgaactaatttacactcccaccagcaatgtataagtgttccctttaaagacttttggtggagtctttaaggttgtctaggtatagattcatgaaggtatagcattgtccatgaagatagatagttcaacttcttatttttctatttggatgccttttatttctttctcttgcctaattgctctggctaggatttccagtactatgttgaataggagtggtgagagtgagcatccttgttttctttcagttctcaaggggaatgcttccagcatttgtccattcagtatgacattggctatgggtttgtctagatggctcttattattttgaggtatgttcctttaatgcctagtttgttgtgggtttttatcatgaagggatgttggattttacctaatgctttttctgtgtctattaagatgatcacgtttttttttttgtttttcattctgtttatgtggtgaatcacatttattgatttatgtcaaaccaaccttgcatgccaggaattaagcctatttaaatgtggtgaattatctttttgatgtgctgctggattcggtttgctagtattttgttgaagatttttgtgtctatgtttatcagggatattggcctgtagttttcttttttgttgttctgtctttgctgggtttggatatcagggtgatgtttgctttgtagaatgaattagggaggagcccctcctcttcaatttgtttgaaatagtttcagtagaattagtatcagctcttctttggctatctggtggaatgtggctgagaacttatttggtaaggggctctttttgattggtaggttttgaattgctaattatgtttctgaacttaatattaatcttttcagggttccaatttttttcctgactcaatcttggaagattgtgcattgccaggaatttatccatttagtctagattttctagtttgtgtgcatataggtgtccatagtaatctctgaggatcttttgtatttctgcgggatcagttgtaatgtcatctttgtcatttctgatcatactcatttaagtctttttctttcttaatctaactagcagtgtattgacgttgtttattcttttgaagaaccaacttttggtttcgtttattccttgtatggatttttgtgtcacaatttcattcagctctgctctgattttatttatttcttttcttctggtagctttgaggttagtttgttcttgtttttctagttcctctaggtgtgatgtcagatcagtaatttgagatctttctaacttttttaggtagttggttagcactatcaactttcctattaacactgcttttactgcatcccagagattttggtatgttttgtgtctgttttcatttatttcaaacaatcttttgatttctgccttaatttcattgtttactcaaaaatcattcagaagcaagctgtttaattttcacataatttaattttcacatagttgtgtggttttgagagattttggcattgatttttattttgattccactgtggtctgcaagcatggttggtatgattttgattttttaaaaatttattgacacttgctatggccaagcatgtggtccatcttggagtatgttccatgtgcagatgagaaaaatgtatattttgtggttggcaggtggagaattctgtaaatgtctattaggtccaatatgtcaagcgttgaatttaagtccagaatttctttgttagctttctgcctcaataatctgtctaatgctgtcagtggggtgataaagtgccccactgttattgcatggctgtctaaattgagaaatagataattttaaaacaaaacaataacaatagttgtactgcaataatgctgccatttaataagcatatagtccgtattgtgtcattcaattctcttaacaactctgtgagatatgtactattaacttgtctatacaacatatgagaaaattgaagctgagagaggttaaataacttgctcagagtctcatacgtaatatttttaagtttctattgctattgcaaatgatatttattttcctatcatgtaccctaataagttgttgatgatgtgtaggaaaggtattgatttttgtagtctgatatttcatttaaccaccctcctggacttttcatatttgttctaatattttatccgttgactacctcagatttttatatagccatattgtttgtgaataacaaaaattttgtctcttgctttcgaatccttattctcttatttttaaatttattttataccttattgcattggttaggacatcaccatgttgaatagtaagtggtaatagtggccatctttatcttgtttctcattttaatattttgtcaataagaactaccaatagcaattcatatttattgagtactttatattgcccgagtaagtgcctttatatattttatatcgtttaatccttgcaacaatactatgaggagtgtactattatttttctcattttttgtggatgagaaaagtgaagctcagaaagagtaagcaattttccaaggtcacacagcttggatggaaccaagatcctaactaaggcagtctgactccaaagcttgtactcataatcaaaattacctcctcagaattttcacaagatttgttgaggaagttctcttctaatctttattggctatggatttttaacatggatggacataaaattttgtcaaatgtgttttcaacatctgttgagatgattatgtgatttgtctcttagtctataattgtatttaattactttaataaatttgctaatgttaaactatgcgtacattcctgaataaactctacttgattatagtgcatcattttaataagctgctagattctattttttctagaatttttatatttatattaataaataagattagtctataattttctttttctttcttgtcctgtctgtctgatttggaggagccgtccatcttgttgtaccctctggaactatttctataaaattaaagttgtctgtgatttgaaggtttggaattacccataaaatgtttagcctttcaatttgttctattatttttctatgattttctactttttattgggtaaattttagtaattttatttttctaaaaattttctcattgaaacatattagtttaaaattctatgtagtattattttatttttaatattaccttggtacctatatttgtgttcatatttggcttcctggtgatattttttcaccttcttcattttttcatattagtatttaatgaaggtttgactcttaaaaacagtctcgttttatggatcatctataatttatttgttttctatttaacagttttctgtttttatcttaatctctcccttccaattcccataggcttgttttatttttattttagctttcaagacagagtctggctctgttgcccaggctggagtgcagtggtgcagtcatggctcactgcaacctctgtctcctgggctcaagcaatcctcccacctcagccacctgagtagctgagatcacaggtgtgtgccaccacgctggctaatttttgtatattttttgatagagactggtttttgccatgttgcttaggctggtcttgaactcctgggttcaaacaatctgcccacctcggcctcccaaagtgctgggattgcaggcgtgagccactgtgcccgacccatgggtctatcttactgtgctgttttgtaaaactaacacctggacttgatagcttagttcgttgacttttcatttgtttataatttctaatatgtgaatttaaggccatgtttttctctgaatattgctttacctgcatctaacagacttggatatatacttcactcatcatctttgattgctaaagcatttgcaatatcaatttaagttcatcttcaattcaagagttatttaaaagtgtgtttatgtttttaatttatagatatatattgcgttgagcttgtgtaatgggagtggggtagttggttatcactttactgctgatttctaattacatttcagtcctgcatagctgatttctgagcccgtattctcaatcgatacaaatggtaatagtctgtcgcagtgtgtgcctctatttcccaatctagaggcagtgtgatgttggcttttttatattcagcaccacctgagagtgagcatttaaggatgtgagaaatgagacttaatgtcagttctcaggagtcagttggtccacttagagacatgtagtccctttcttacagacccctcttcacgtttggaaagaaggtgtttgtcttatgagccctctttgtcagtcaggacacatcatgttgacttatctaatcctactggtttgtagctacacttcggtttctgggtagttggttatgggcatatcccataggttgtgtggcactgaggaagtagaatattcaaagtcctgtcctggagaaaaaacaatccatctgtccatggaggctaagagttctagttagtttttcttccagttaactccactgccttcttgctcttcaaacctactgtttctaacaaagaggatgatgtatatattaccttctatattactatatatttagatattcttagcaagatacaaacaatacaaaatatgtatttgtcttgcttagcagtctagatgaatgcttcatctcccttggtgcctcatctgtaggaacacagtatcattgccttgtgacacaagtctgtatctcgtatctcatatctcagaacaggggcctcctttagactgctttcatggtctctatctcctcccactgctactggcaatacctttactgacacctcacacatacatcctgagaatagtggggtttaatttgttttccaaatgaatagggttgtcccctcccccaagtggactccagaacagtgtttcctttctgtgacacttccattgtttttaatgttcttacttccttgacgacccttaattggggtcttttgcagactgagactgactgcctttttcattttctcttctgtatcactaatgacagtgcagaataaagtggtacctaacattgtgttctgctaacctttctgccagatagccctatgcattgcattatctattagtttttttctgttttatggtcaattttctacccattcaagccactaaaaaatgattttccattatatgggtacaaggtaatcctgagacaaaacaaacaaacaaacaaacaaacaacaacaacaaaaaacagaccttcagctgtgattccagggtagggtagttgcaccaacccacagctgttatgaagcccctatctttatatagctgaatttgatcatttatatggacaacagctgaatttgatcatttatatggacaacagctgaatttgatcatttatatggacaatgcaggttagtcttcaactgtgtatgcttccagtgaggttacttgtactctgtgattcaaaaagttctggtcatttgtctaggccacagcattcctcaaaaagagacatgatacctttctaaggctgagccacatttgctgtagaaaaatctttgcaattcctttgcagcagggaaatttttgcaactcaagatgaagtggggcagggcgagaaggcttctttgactgcaaaagtatctgaaacgaagggtaaggcctttgtgtacttgtagtcatcattatacttcatgaatagctctttcaaatgaatcatattaatagatctcttagaactggaagggactttgaggctacctgatgtagttcccttctttcagctgagaacgatatttctttaatctccattttataggtgaggcaactgagttccacaaaaacaatgccattctgtagtctcaggttcacctgaaaacattgcatttgactctgccactgttcatacttagcccaccttttgatagtctgtcttattcactgctttgagctcatgatgctctccaaagagcccaaccaggttgttacatgctgtgcccctggtagggagaattttcatacctgactcccataattgagggcagatatgacacattcctgtttgccgatagagaattgtatcctttaatgaagcaatactttcctgagcctctggagctgcatgtggttctttcacatgcaacctgtcatttttccaaccctttgatgtattaaaatattgtttccagtgatatttcacagtgcacatgtaattatcaggtattggactctagaatttgtgtaagttgtcccatctaatgggacagtctattccttgcttacaccattcagctggatgctaaaactgttttgggaattttcacctacacccttgacaagactagttcagtaaggccatatttggtctttggaaacagaaagaactggattcaaaccttttctccactatgaaacagtgaccacataagtagctgtgttacctaggaaacatcactttaagcattctgtgcctaaatttccttatctttaatggaatattagtaatgtatgtctcatgggtttgttgagagaatagagataatgtacatatggaatttagctcacataatgactaccacatgtaaggatttaatacactattattattgttctcctcctcctcgtcatcatctctctatatttcagagttgctataagattcttaaacaaaatggtgtaaactatatagcagtttctcatctctagtagagtctcaaaaatagcaactcttatgagtatagttaattaaagcactggaaatattaaatgaagctgtcacatttcttgaacatggcttatttggtcacacaggtggtttatcttgaacaaatagtactgttcaaattttctaattcaagtccacatgttccagccagagagtagagtggtaaacatcatagaatcctttagaaattgatactttctctgaattttcccattaagtttctcagttttctaaatacaagactaaaacacactcccagaaaataatttcatttgagtgtagaactgtgacaaatgatatcaccaaggtagctaacaaacagatacacataattttcaaggcaagatttctagatgttctctggttacttggtcttaattatcctttgatgtcagcaaccatctgctcaccctttcacatacataattacccagccaaacttgtacactgtactggaaatttcaaggggttaagattaagaaagaccttgattctacttgcaatctccactacttgctagctctatgtccttggccaagtctcctaatgtgtctgaatatcagttttcatatctacgaaattgctataaaaatcatttcccaaccacttatccaaaatccttggtgccaaataagttttataattcaagttttgtgggctttttattttaaaaatactgcatgttgcataacaccttcagtgggacagaacccggtaatcaatcacatcaatatttctgcaacaaagcatatgaatagttacactgagagtgcctcatgtcaattcacaacaagttttgtcaccaggcaagttttagcaacaaacttatgaaaaactgtttggtcttcagagctttctagagtttgtaattattaatggtggactgaaacttgtatctgatcacatgagattgttctagggattacatgaaatgcattatgtgtagcaggggtcctgatgagagtgaattgatattctgacacatctgggtatgtgaagacccccatatgtttattttcttgagataatctgcagaaggcaaaaggctttatgcagaggagggctgtgtcagaaactgaatttgtagggatggaggagcaatctgataagatatgatggtgtttgttctccaaggacagtaaccaagtttgaaagtctgagctagggtggtgggagtgggttgttggggagatgttgctgcagtaagaagctgaagatgtttttctcacaggagcctcactcagatacaggttagaagcaatattgtttcagtgtccaggtgacaaaattatagcacagaactgaaaggggcattcctacccttctatgtagacccattgttggtttcagacaaagctgccagaaaagagggcagcaccatttaagcccctcagggatgtgtagctgggagcacttcagaatccatactcccccacagtctagcgggggcctccatgttcccacagccacaggtactagtaccatcagtagctggactgggttggaggggctaccactatctttcattagaaacacaagctctgtctagtgaaaatggacacataacataccaaaacttatggaatgcagcaacgttccctattaagagggaagctgatagtagaaaatgcctacatcaaaaaagaagatcttaaataaataacctaacattacacctcagggaactagaaaaaagaacaaactaggcccaaagttggtagaaggaaagaaataataaaaatcagtacagatacaaatgaaatggagaatagaaagtcagtagaaaagatcaataaaagtaggagtggtttttgaaaaggtatacaaaattggcaaatgtttagctagactaagaacaaaggagagaagactgaaaatcagaaatgaaagaacacattgcaactgatgactaaataaaaacaaatgatcataagaatctactatgaagttatatgccaataaattagataacctagaaaaatggatacattactagatacatataatctacaaatgttaaatcatgaagaaatagaaaatatgaacagacaaatggtgagtaaagacattgaataagaaataaatagtcccacatcaaggaaacgctcatggtctgatgccttcactgctaaattccaccaatatttagagaactaataccaattcttctgaaactctttcaagaaatctaagaagagggaatacttccaaactcattttatgaggccagaattaccttgataccaaaaactgacaaagacataacaacaataaaaaattaactgcaggtcaatacccctgatgaacatagatgtaaaaatcttcaacaaaatactagcaagataaattcaacagcacattaaaaataacattctttatgatcaaaaaggatttatctctggggtgctagaatagttttacatacacaaattaataaatgtgatgcaccaattaaaagaataaaggacaaaaaccatatgatcatttcaatagatacagaaaaagcatttgacaaaattcaacattctttcattataaaaactctaaatacattaggtttagaaggcactatgatttggatatttgtcccctccaaacctcatgttgaaatatgattcccagtgttagaggtgggggcctgttgggaggttattggatcatgggggatgatccctcatgaatggcttagcaccaaccctttggtgataaacgagttcttgctcagttagttcatgtgagatctggttgtttgaaagagtctgagatctctccccttgctctcttgttctcactcttgccatgtgtcatgcatgttccccattcatcttctgccacgattataagcttcctcaggccctcacccagaagctgagcagatgttggtgccatgctttacaggctgcagaaccgtgaactaataaaccattctttacaaattacccggccccaggtattcctttatagcaatgcaaaaatagcctaatacagaaatttgataccaaggagttgctgtaaagatacctgaaaatgtggaagcagctttggaactgggtaacagataaaggttgaaaaatttgaatgttgcagaagaagacagaaagattagggaaattttggaacttcttagagactcattaaatggttgtgaccaaaatgctgatggagatgtgggtagtgaagtccaggctgatgaggtctcagatgtaaatgaggaatttattgggagctggagtaaagatcattcgtattatgccctagcaaagaattaggctggattgtgttcatgccctaggggtctgtgtgtgtttgaacccaagagtgatgactttgggtatctggtggaaggaatttctaagcagcaaagtgtttaagagatggccaggcagcttataacatcctacaatcagatacaggagcaacgaaatgacttaaagttggaactcatatttaaaagggaagcagagaaaaaaaatgaaaaacttgaagcctagccatgtcacaaagaaggaaaaggtattttcaggagtggaattcaaacaggctgtggagcaatttagattatcacaactaaaagggagccaagtgccagtgtccaagataatggggaaaaggccttgaaggcatttcagaagtctttgggacagctcctcccatcacaggcccagaggcttaagagtaaagaatggcttcatgggccaggcccagagtgccaatgccccgtgacacctcaggaggctgcttcttgcatccctactgctccagctccagctgtggttcaaagggccctagatacagctcggaccactgcttcagagggcacaagctgtaagccttggcagcttccatgtgatgttcagtctgcaggtacacagaatgcaagagtgaaggaggcttggtgacttccacctagatttcagaggatgtatgggaaaacctgaacaaccaggcaacagcctgctgcagtagcagattccctgacagagagcctctactatggcagcaccaagaggaaatgtgaggttgcagcccacactcagagccccaaccaggtactgcctggtggagctgtaggaagggggttgctgccctccatacacaagaatagttgagccagcagcaactcgcatcctcagcctagaagagccacaagcactggactccaacccatcagagcagctacatagtctgcatctagcaaagccacagaaatgaaactgcccaaaaccttgggagcccatccctcataccagtgtgccctggctggtggacatggagtcaagggagaatattttggagctttaagatttagtgactacccttctgggtttagacttgcatggggcctattgccctttccttctagccaatttctccattttgtaatgaaaatgtctggtcaatgcctataccgccattgtaccttgggagtgaataagttgttttttttatctcacaggctcataggtctccagatgagactttggactttggagttgggacttttgaattaatgctggtatgagttaagtcttggggggactattgcaaaggcatgattgtattttgaaatgtgagaaggatgtgagatttgaggggccaggggcagaattatatggtttggatattcgtcccctccaaatctcaagttgaaatgtgattccaatgttggaggtgagacctgttgggaggtgactgaatcagaggggatgatctctcatgaatggcttagcaccatactctaagagaaaagtgaattattgtgcaattcatacacgtaagatctggttgtttaaaacaggctgtgtcctccccgcttgctctcttgtttccagctcttgtgatatgatgtgtctgcttcccctttgccttctgccatgattgtaagcttcctgaagcctcaccaagagcagatgccagtaccatatttcctgcacagcctatagaactgtgagccaaaataaccctcttttctttataaattacccagtctcaggtatttcttgatagtaacacaagtgaactaacacagaaggaatgtattcaacacaatgaaggtcatgtatgacaaacccatagctaacatcatacttagcagtgaaaagttgaaagctctttgtttacaatcaagaacaagacaaggatgtccactcttgccacttctgctcaacctagtactggaattcctagccagagtgattaggcaagagaaagaaataaaaggcatcccattcagaaaggaagaagtttaaatggtttctgtttgcaaatgacataatcttatatatagaaaatcccagaaactccaccaaaaaaaactcttggaaattataaattcagtaaggttgcaaaatgtagtactgctactatacactaataatgaactatccccccccaaaaaatcaagaaaacagtctcttttataatagcattaaataacaaataagatatactatttaggaataaagaccaaggaggtgagagatcgctacactgaaaactataaaatattgatgaaagaaattggagaagatacaaataaatggcaagatgttccatatacatggattggaaaaactaatattgttaaaatgtccatactacccaaagcaatccacagattcaataaaatccctatcaaaattccaatgatattttttcacaaaaatagaaaaacaatcctaatatttgtgtggagacacaaaagagcctaaaggaccaaagaaatcttgagtgaaaagaacaaagctgtaggcaatacaatgcctgtcttcaaaatatatcacaaaactctattaatcaaaacagcatggtactggcataagaatagatatatagaccaatggaacagaatgaacagccaagcaatagacccacacatttaaggtaaattgatttttgacaaagatgccaagaccacacaatggggaaagaacagtctccttaataaatggtgcgggcataacttgatatccacaggcagaagaataaaattagaagcttcactcataatatacacaaagactaagtcaaaatgggttgaagacttaaatataatacttgaaactgtaaaactactagaagagaatatagggaaaaacctctgtgacattgatctgggcaatgatatttgacctatgaccccaaaagcacagacaactaaagcgaaattagacaaatgggattacatcaagctaaaaatttctgcatagcaagggaaacaacacagtgacgagacaccctatggaacgggataaaatatttgaaaaccatgcatctgatgagggattaatatccaaaatgtataagaaactcaaacaactcaatagcaagaaaacaaataacccaattaaaaaatggaaaaaggacctgaattgaattgacatttctcaaaacaagacatgcaaatagccaacaagtatatgaaaaaagctcaacatcactaatcaacagggaaatacaaattaaaaccacaatgagatatcacctcatacttgttagaatgactattatcaaaaatatggaagataagttttggtgaggatgtggagaaaggggagcctatgtaaggcacaccttcttttattgtactttgtttaattgtgctttgcagctatcatagttttttttttgttttgttttgtttttttttttttacaaattgaaggtttgtggcaacactgcatacatcaagtcattcagcatcattttccaacagcatcttctcacttcacatctctgtgtcacacattggtaattctcacaatatttcaaactttttcattattcttatatctattatattgatctatgatcagtgatactactattgtaattgttttgaggcaccatgaactatgcccatataagatggcaaacataatcaagaaatgttgtgtatgttctgactgctccaccaaccagctgtcctcccatctctctccttctccctctcctaagccctgcctattttctgagacacaacaatattgaaattaggccaattaataaccccaaaacagtctctaagcattcaagtgaaaggaagagccgcatgtctctccctttaaataaaaaactagaaatgattaagcttagtgagaaaggcatattgaaagccaagatagacctaagctaggcctcttgtaccagttatccaagttatgaatgcaaagtaaaagttcctgagggaaactaaaagtgctactccagtgaacacatgaatgatgagaaaacaaaacagacttattgctaatatgggcaaagtttgagtggtctaggtaaaatgtcaaaccagctacaacattccctttagcaaaagcctaatccagagcaaggcctaactttcttcaattgtatgaaggctgagagaggttagtaaagtgccaaagaaaagtttgaagctagcagtgattagttcacgagatttaaggaaaaacgccatctccataacatgaaactgcaaggtgaaacagcaagtactgaaggagaagctgcagcaagttacccaaaagagctagctaagatcattgatgaagatggctacactaaacaatgaattttcaatataacaaaacagccctctattgggagaagatgccatctaaggactttcatagctagagaagtaaatgtctggcttcaaagattcaaaggacaggctgactcttgttagaggctaacgcaaccagtgactaagttgaagctaatgttcatttaccattctgaaaatcctagggcccttaagaattatgctaaatctactctgattatgctccataaatgaaagaacaaagcctggatgacagcacatctctttacagcatgatttactggatattttaagcccactgtttagatacactgctcagaaaatgattcctttcaacatattactgtttgctgacaatacacctggtcactcaaatgttctgatggagatgtacaaggagattaatgttgttttcatgcctgctaacacaacatctcttctgcagcccatggatcaatgggaaattttgactttcaagtcttactgtttaagaaatacattttataaggttataactgccatggatagcaattcttctgatcagtctggacaaagtaaattgaaaaccttctggaaaatattcaccattctagatgccgttaagaacatttgttattcatgggaggatatttaaatatcagtattaacaggagtttggaagaagttgattccaaccctcttagatgactttgattaggtttaagacttcagcagagaaagtcagtgcagatgtggtagaatagcaaaagaactagaattagaaatggagcctgaaaatgtgactgaattgcttcaatctcatgataaaaattaaacagatgaggaattgcttcttatggatgagcaaagaaagtggtttctcaagatggaaagtactcctggtgaagatgttgtgaagattgttaaaataacaaaggatttgggatattacatgaacttagttgataaagcatcagcagggttggagatcattgacttcaattttgaaagagttctgctgtggataaaatgttatcaaacagcatctcatgctacagagaaatctttcacgaaaggaagagcccattgatgtggcaaacttctctgttgccttattttaagaaatttccacagccccccaatctacagcaaccaccaccctgatcagtcagcagccatcaacatgcaggtaggaccctccatcagcaaaaagattatgagtcactgaaagctcagatgatcgataacattgtttttaacaacaaagtacttttaaattaagctatgtatattgttctttagacataatactattgcatacttagtagactgtagtattatgcaaatgtaactttcatatgcactgagaatccaaaacatttgtatgaatcacttcattgcaatatttgctttaattgaagtggtctggaaccaaaccgtcaatatctccaaagtatacctgtacactgttggtaggaatgtaaattagtacaaccattatgagaaacagtatggagggtccacaaaaagttagaaatagaaccactatatgatccaaccatcccagtactgggtatatatttaaaggaaatgaataaatatgttgaggatatagctgaattcccattatgtgcagcattattcacggtagtcaagatatgaaattagcctacgtgtccatcaatggatgactggataaagaaaatgtagtatatatacactatggaatactattcagccttaaaaaggaaggtattcctgtcatttgtgacaacatggatgaacctggaggacattatattaaaggaaagatgccagggacagaaagacaaatgctacatgatctcacttatatgtggaattttaaaaagttgcttaactcagaagcagaaagtagaatagtggttaccagaaccggggggcaaggactggggagatgttggtcaaagggtataaagtttcagttagataggagaaataaattcaagagatctactgaacaacatggtgactgtagttaataagaacatattgtattcttaaaaattgctggccaggtacggtggctcatgcctgtaattccagcactttgggaagccaagtgaggtggatcgcttcagcattcaaactcttgagctcaagagttagagactagcctgggcaacatggcaaaaccccatctctacaaaaaaatacaaaaattcaccaggcgtggtggcacatgcctgtactcccagctacaggcagaagtgggaggatcgcttgaacacaggaggttgagatttcagtgagctgtgaatgaaacactgcattccagcctgggtgacagattgagaccctgtcacagggtctcaatagcaagagaactagaattagaaatggagcctgaaaaatgtgactgaatttgaaagaaaattgctaagacagtagatttttaactgttcttactataaaaaaaagataagcatatgaggtaatgcatattttaattaggtcagtttagccactctacaatgtatacatgtttcaaaacatcatgttgtacagaatatatgcaattatttatcaattaaatatatatgttatatgttatatatgtcatctagaatttttcctgacagatgatagacatttagcaatgtttttaaatggatgatattctcctgtatatttttctcctccttccttgatacctgactgtgagtttcttaaaggcaaggagcatggatatagttctagctttgtatcttctatgtctagcatgcttcttgacacacaataggtgttcaaaaataaaaggttgttcattgcatttaattgattttacattttaaaattgataatacattttaaagacaaaaaataagtcataaaaataagaccatcacaatgaaaaattacgaagaaaataaaattaaaaaaaatgaaagttccttaataagaggaaggcttttggctgtcgtggtcccctctggatccccagtaactgagcaactgcttgtgactaagaaacgtttgttgatcgaatttgttggcagttgacattcacgaagagagtgagagtggaagaacaatatgaaaggactgttcctgacaactattagaaataactgggtagagcttaagggggactgaggctctctattacataggtggggatacaagtcagtgaaatttgagttatgaaagtgcatgccatttcatttgtaatcaaggtgaggtatggcctgaggaaacttgaggcctaacactttataaaggttcaaaaatgtcttctgttgagttctgggtattagatagctaagcttcatgtagacaccaagtgggtcttggaaagtttctcattataaagaagaccttgggggtggggtaagtgtggacaaacaagggcttattctggcaagttctcattgggcttagttgctccatttgatctttgtgatgttactttggaagaagaaaggggcaatagtcattggttgggaaaacaggaaaaaggaaaccagttttacttggattattactattaaggtgaattcatttgcacccatgccctggctaagcatggggaaatgcaagtgatatatgtcaactatctagaatttttcctgacagatgatagacatttagcaatgttttttaaactgatgatattctcctgtatatttttctcctccttccttgatacctaaccatgagtttcttaaagtcaaggagcacggatatagttctagctttgtatcttctatgtctagcatgcttcttgacacacaatagatgttcgaaaataaaaggttgttcattgcatgagacatgttgatgattaggatatggattattatatgcaaattagtgccaaagaaatatttaaaagaaattattttctcccaaggtgatttaatcccatctgatatgaacactaataatttgcttagctaacagttttttgtttgaaacgcaaaaggtaagtttattccaccctaggtctgggattattacaaaactgagttggctagatccaaatgaatgtggttttcctgtttggttttcttgtcatggctttttactttcctttcccataaatcaaaatacagcacagaaagtctttttcttcataagatttggtatgccatggctactggtttcagttggctcacatttcctaagtaatcccttacctcattctggttcatggctatttttaataaggccttcatgacttgctgctctcctaaattagtttattcatttgtctgcaacttgactttaaaaaggctccacttgaggaggctcaaatcattattcattccatatcctctctcacttatgacaaggctagattttgttccctttctctgttcccagatttattcatatgaaccctctctgttccttaacctcttctttaagtggaacatttcctcctttcctttgccacctgaaatatgctctaaacattcgaactgatgaattatattcttgtttgtgtccttccttcttcctctattttcatctcagccatttcttggcctctttgatctactgctacaaataagacattgtctctgaatgtttcattctggaaggtgcagctctatgctcttcacagtaagcaagggagagattctccactcatgcagtacctacaattgctctacgctttccccattgcatgaaccaactcttttctttctacagcatgactttcacttggttcacaaatactgcatgccttttggtgcttggcagagtgctaggcattgaacagagagtggtgatcgtggccttgccagcaagcactgatcttatttatttagtttatggacagtcaactctttcaaccatgctatggataaaagcagtttcaaaattatttttatctttttgattgcagatgtactcatcctgattaatcatacattaaaaattactttgcatttcttgcggtataaaattcaacaaccctatagtgtgctggagaactgactggctggtccattcaaatgtgttcatggaatatccacagggggccatacaatgtttgtcctatttttcttgcacacacatttctattgcttcctgtattagctatctttgtaggcatctggagggcaagggccaggtctatttgacgtgaattgtagggaaactaggtcagaggcacatcactcttttgtgaatgtgttatatattcaacagattattgatttactggatttaatggattttcttttctctgtgctttataaggaaagaagtaactgttaaatgaaacaaaataagcacaggctataaatgtttagccctaactgtgaggagggtttaaacatgggttgcttatcttctgtgtcttctgtccttattgattttcatattccaccctcagctcaagctatgcatttgatattgttgacttctagactgctactttggggcctgcctcccttgctgcgatgtggatggatgacacccattttttttctagttaagcagagtaactgataagttctgatgtcaagtttgtcgatgcttcacaaccagggaagtttttaactacattgtctgacagctgagtcatccagcctccaagcctttctatgatacatttttctttctaattcagaaactttgaaactatcccttcgccaactcaggggaatgtgtggggctttatgtttcattttagtgccttccttttttgtgtgtgatttggtgcagtaaattatctgaaaaacgactacccctttttataggagctttacaaatgacctactgagtaaatggcctagtccatgtctctgggccgatatagaaacagctttgggctctcagttcacccaaaatggtctggggagagaatctccttagatgaaaatgtattttaacttttttagtacaagcaggctttccaaaggtggcagaaagcatggaacttatcttaaagtactgagttggttttagatgtaattttaaaaacaagataatttgattgtttaaacacgacagtttttttttaaagtaatacgtcatagccaatcaaaattcccaagccagaaaaaaatgtttttttcaatttagccagtctgctttaaatctaggatatcccaggggcttggctaaactagccatgagattgctccccaaccccactgtcacctccagccttttaaatcaaaaagcataaaaatgtatggcagcaaagaaagatgctctgaggcagggactagccttgactcctaatatggtcagattgcaattaaccagaggatcagcagctctgttaggcattttaaatttctgtttaactcaaaagccttatttttgtttgaagcttcttggagttgagtcttgctttaaagtatgaatgcagaagtctgcctttgaaaacatggtgtggattactgaaaagatggtgtgaatgactgagaaccctggaggtcgtgggtatcagaaccaaccttgttgggggaaggactctttagcagtgtgatttgcaatttttcttctccaaaatatccctctttcatctactccccagacgcctgcagtggtgtctacattttcacctctgcaactcattcctttgattgaagcattgttgcccactccagaaaggttctcctaaaatacacagaacctaaaaggagcaataaatgaaatcgataagaccgtacagcaaagaagtcaatcagattgtctcctttctagatacaggaaggaaacgggcagtgactgtagctcattgggctttggggtatctgggagaagtccttaaaaggaagactggaacacaggaaaggaaagaacacaataaaactaatttcataatatttttaagaataagcctgttatgtccatggatcattagcttaaaccgtagagagaagactgtgatgtcagcttgtgtgtgtgtgtgtgtgtgtgtgtgtgtgcatgtgcacatgtgtgcactgggcaggggggcggtggggggtgggcacttttttcaaagtgcaatataacaaaaaatattattctttgaggcgctgtttgtgggattctagatagtttagattttaccacaaatctgtaagagaaagtaaggaatttgaagattgtgtcatataaataaaacaggatacactcaccatcaccctcccctaccaagcaaatccaaataaagcctagggttgggggaagaatgataaatcctcagtccccacccccaatatagttgtgatagatgtctgataatttcaaccggagtgtagggagaatggtgttctgtctctttacctctctcttaagaacagaattaggggatgtaaattgcaaaaaacctgagttaagagttctttctggccttacatggtggtgaaaattaaaaagggtcaaagacaatctcacgattagtgagaaagtacacccttcccaccccctgccatctaccaatcccatttacaaagacgccccatgtctttcaaaacagagcccgcaaattaccatgaaaatctgccccaacagactgtgctcaagtagaagtcagagcttttgttagcaggggtttgtgggggatggcaccatagcgaacacagttaagcctcactaattccctgaatgagggaaaggccaatcttgatttgtaagaagcttgaatttgaaaatatgtttaaagaaatgccatgttattatttctaaaaacctgcagtcaaactgctggctggggtctgtgctctgagctgcctagactctcaaggcctcaaacaaacagataaggactataattagcatattggtaatttgaatgcaaagtgcacttagagtggcgctttaaaaacgtgtgttagcgtactctcctagcaggctgtcacttttctatgtttatagtattaatttgcctagcaacttgccccctttcctttttggcagtaaactttagcctcacatgtcagaattcgttaaattttccatattagcagctggaatgaacaagtaagtgtgtgtgtgtgtgtgtgtgtgtgtgtgtgtgtgtggcagggtttgctgtgggagagaggtggtgaaccactttttaaaataattatgaacatattgtaaacttctattctgctgacctttaaaattcatcagttaattgatatttatttattgagtagggaatgtattctcttggatgattaaaaagggtaggaggggcaagctgtttcaaatgtccttcccctacaagtggtcgtatcaagtgaacatgagagaacattgactgtaagaagttcttgcattattacaaaaaaaaaaaaaggattgattatgaagtgcaacaggtgcttaattatatgaaacaacagcacactgagatctgcatctatcaaacacatcttccatggtcagccaatcctgtgtgcacatattaactttgtttgtaaattcacacttgagaccacttaatttgaagtgtgactgagttctgtttgggaggggaaaacagaagagaagattaatacagcttcagttttacccaaatattcaatatcttcatcattttgctgtggacgtggaagaaaaaggggatgttcattaccagaacgaaccatctggtaatcaggacagggactgcaaaaaaaaaaaaacaaaaaaaaaaaaaacagaagacaaaaagcaaacaaacaaaaaaacctgggtaaagcctccaagaagatcaaatttaatgccttctccttgagaaattccccccaccccaccccattccacttcctggccttcttcagacactcagagacatcagacactgagggagatcaggagagaataaccacaagcctgtggaagaaaaatagtccttaagtaatgaaatccctaatacagtggttcccaaattttgctgcacatcggaatctgagattagaacctgaggagattttttaaaaatcctagtgtccagattcatgctatccaattaagttagaatgtctaggggtaggggccaagcactagcattttataaaaatcaccaggtggttccttgtgcagccaaatcgagaaccactaccctaatgctttcccactttacatgcatttaatttatatttaaccttcccaattaccctaagaagaaggtgctgttggatccctcatttcacagatgaggaaactgaggttcagagggactaaatacgttgtccaaggttatcaaactataaaatagtgaacctgggatttgaaggccagcggtttaattacagagactgcatgctggacgtctatgtaataatgtccctcctggcttttgtccttgtatccagtaccattacactaaatttgatatagaacaatcccacatcaatgtggtgagagtttattagacatctgttatgtatatcatacccattttagtcacactgtgagcctctaggtagattctaggaaatatggctaacttctgatcattcaaggggttttctaggtaaccctggcttggttaccatttgttatggtaaagcttaattagccaaagactgtcagagacaagactatagtcccacaaactcaaatttattgtgtggtttaagaactgagtatctccagtaataaatacaagtagcaaagcaggtttaaggcatcactggtaagaaaggagtagtcactcaaagtaggcggtgtagttatggccttttacaactgccgtgtgaccttgggagaaagtgttttctattaactttgcagctggctttatctgtccattctcccagcctgattaatggcagggctgctttttcttagctcaaactgactttcactctttcagttctggggaagttttgactttttcaggttttggtccttttcagaaagggatgagcccgagaaaaatattgacattcagattaactattaataatgttgctcctcttcagccaagttggtaaaatagttaatggaaaaatgtatgtaaaaaccaggcaagtctgaataaagtcagtatttgagttagtagtcatatactaatgtcagtttccagggatttgtcaatgtactgcggctgtgcaaaataaaatcaatataatatatcaaaatattgggggaactcggtgaaagataatgggaactctctgtactatttttgtaactttgtgtaagtcttaaactacttcaaaataagaaagctataaaagatgtttaatgggagaacaggtttgtgttgattatctaaataagacttttctaaattagtctgactttaggcttttccatgaataacccaaaattggttgtaccagtgttctcttttatgcttctagatttgaatattgggtactgtagtgatatcagtggattagtcaacatccatatccaccaggtacagatccctttgggattagaaatataagaccagtttgttcatcaacaagatgccatttgagtagagtctggaaatatgtgttcaatatcattgggtagggaaaggagggagaaagttgtggtaggcagagggaagatcaggaggaaaggcacagagatatgaaagtcaaggcacatcaaggaaacagaggaagtttgatacggctgaccctcggggtataaggaaggagtggtgggaaaaaaccctggaaagatgagttacagctggagtgtgacaatctggatgtgattctcctctctgtgaaattaaagaatttagacttcttttgtagtacttactacatctgtcttgtgtcatagtttcctgggtgtatattttctcttcccaactagattccaagtttcttgaggagatgccccaagtttgactcacctatgtagcgtccgtagcacctagatgtgtgttttgcacttagtaggaactgaataagtctgtcctaggaatttctaatgtaccacaaagacgccactgatattccctctcaagaacatctggagccccacgagaatatagagtgaggtgtttacctccagggaaatgaaagtcgcaagcagaaaagcccacaaccaatctccctcaatctctcttcatgtagggctttggggactgggtttggccatgccctaccatctttgacacatagccctcttttccccggaccatgcccataatgaagccccttgaagagaggtaatgtgctttgccttagtcaatttggcattccactcacacctccctctatttagctttactggagggttgcagaggttcctcactccttcaccacctgttcctcatgtctctggattatagtggatacatgagttcaagagggacctggagagggtagatatggaactcttcaagattgtttccaggatttgcctgacataaattgtctgagaggatctccaccatttgccttttggtgatttattttctcttcgcctcctgagagaaatgttctattgctcaccatttcagatggttgggtgtggggatgggggcacttctgttcctgacaacctcattatgtggttatcaggagcagacactgcccaggttgtcacgacaaccagcaatgattcaaagcttccctgaaaggtctgtatctccggcaaataatcagcctttagctctcagcagatgctgaactgagcagccaatcacaggtgagctggaaaaacatgacatcatagtccagccggtccaaaaaaaataaaaataaataagatttggttttctctttacttccttcattctttatcccctagattttgttttctactttctccttctctttttccttcttagtaaaatggggagagcaatgaaaccaactttccaaattcaattcactctgcaggttggacttaggttccagtagtgcagtgattgagatcatgtaaggaaggaatatataatatgatccacttgggagaaaaatcaaacagagcatcagctcaattaaacaatgtggtttgatatgtaggaccatggtggaagcagggctaattaaaaccaagtcagaggagaggaactttctaattctcatattaattcacccagagccacctggatttaattgtcttctgcttttccttcactaactccctggtggaagggaacagggcaaaagctgggggcttcagaaagctcgtaggttctacagggcaggtctctaatgggggataattgtagtgaaagaaggtcaggagaaatccttcattcccaagctgccaccatttagggagcatatgtaaatgcgactcatcaagtctattaaggagatgtatagctcagaaatctgttaaatctgcttttgttccattagctgtttgtatccatacaacaatccaaggagagaggcaaggcgagttcgacaaaggagaaaactagtgcccagcgaaatttgagtcttgttcaggatttcctctccagaggctggaatagaacctgggtttcctgatttccaggaaagaactcgaagacccaagagaatggtaacttcccagccatgggctttcctctttccctcacctctgatttttcagagacctaggacaagacctcttggcatctctgatgctccttgctctttgcccagcaggtaacccacaatgctgcctgccacagaagagcttgagacccctatgatgggcatggggaggcaggaaggaaggggctccattgcaccagactgcagtaatggcaacgggttgtagtgagcggccctgagtgaaggaggagtaggcactgtgctcctagccaatgctgtgcaccagctgccaaaccccaggttcttttgtattcaaagagtggggacactttttttttagtgcagctgctgtagcaaaagatgtgaagactgagatccaaacagacccagagtccactactgggaacaacttctggctgtgggacttgaggcaggggtgggaagggagcaaggaaatctgggttgcttttgcccagtgggttattcattactgccttgcattcagtgcctgcccaggtatggctcagctcagtctggcacaccatagccttgattgctacacctgaatcattgacctggcattcagacctctttcaggatagcaggggtagtttgcttgcttttgtcttaaccaaaataagactgtatttcctatttccccttttaatgatgtttcttacaagtaaaatatagcatatgcttattgtaaaaacatacaaacaagacagtagtatataaagaaaagggttaatgtcccccatcatatacacatacccacatgtctttcctaccctcttttattcccagagtgtcccctttagcagttaaaacacacacatacacccaattttttaaacaaaaataaaatcataatacacgtgctgttctgcattttttcactcaagaatgggtcaaggagtattactatttcagtacagaggggtctatatacttggttttttaagctgatgcatagtagtccaaaatatgtatctaccataatttatttaatgattcacttacttgggcaggagaaaactttgggaggtgatagatatgtccatgccttggatggtggtgatagtttcacaggtgtatacttattcccaaactcatagagttgtatacattaaatatgtacaactttttacatggcaatcatatttgacaaagtggctaaaaaaacaacagttcccttactgagggacatttaggctacctttcatgtaatatttttcattcttatataatattcagcataacatatttcaacatttcttgacatgtttttatgaatatattcataatcagattccttgagttggaattgctgggtcaagtggcacatgcattttaacatttcctaagtactacccacttgtgctcccaaaaggttgtgccatttacactcccgtcaattgtatatgagagtgagcaatgttccttttatccaggatttgactgaaacagtttgaagatattcatttcagtttacttctgttattaaaagccccatcccagcgcttctcacttctcatgtgaatcaaggggctagttgggttggtaaagacccagagaagatatacaactcaagtggccatatagggtggcagaacaaacatagaactgagaattggagacctggtttccaggaccatctctgtgaagcactggacaggtaacttcaaacccctgagtctccattctctcatctatgaaatgcagatcataataattgccatagtaaactgttgtggttgttgtgaggatcagatggggagatacaaaagtggtttgtaacctgagaagtaggatacacatgccaagtggttatgatggtagtgttgtaatacccttaaatcaaagagctcccaagcaagagaacagtgagttgggtggtaaaaatggtgagttgaggggaaaaattacacagatgaaatctttaagatatttcagattggaatcccttcctgagatctcccatgcagttgccctatattcttggagaacaaaccatgttgacagtaaagactgctttctcgtatcaagaataacataggttatcaccctttcataggaagaccctaggcttgggtcttaagtccagtcctctttctatgacatcactatgctttgtcagtcacctaataggattttgtccacatgctactttctacaatcactagggagaaaggaaatacacccatgaaatgtttaaataaccatgtgtggtgactgcataaatagctctgagttatagctgaggtatatgggaggattagagtgaaatcaaataccttctcattacaagttaaatcaatagcctagaagacccaagttaaatcattagccaggaaaatccagttatatttttctatttcttaaaaaaggttcttgtttaacccaaataaatgcattttacaaatcagagatgttaacattgaataaattacattcattttgatttgtgatttttttagattatttttaccatggtgtagaaaaaaaccagtgggatgtggttgctttttttttttaactccaaagttagttaaaaagatatctgtaaaatcactggagtcagaaccatcctgattccaacttattaatgaaggatttgagaaagagtgttgtatatttttgcattaaagacaaccacgacaccaaaaaagctatttttaaaaatgcctgattttttaaaaatgccaatcttatatagtctgtttcttttaaagcaagtatgtattttaacaaaaccagtaataccacatttaattcttagcagtagtaaactgtatcatattagaaaaagcatggactttggactcatttcgatacaaatcccagctctaccactttctacaatgttaatgtaatactcatatatgcattaatatatatattttgaatttaggaaaataaaatgcaaactgacccttaaaaatggtctggattacatcgtttacttagtctttgcctccctctttcttgttttggcatagagtggatcattgttgttgtttttctcaattccctgtatcatcacaatttaaaatgaatcagtccaaaagaggcatcccattcttcaactgcctgagatgttttgtctggcgaatctgtagctctttttttttttttttttttttttttggagacggagttttgctcttgttgcccagactggagtgcagtggcgcaatctcggctcactgcaacctccacctcctgggttcaagtgattctcctgtctcagcctcccaagtagctgggattacaggcgcatgccaccatgcccagttaatttttgtatttttagtagagacggggtttcatcatattggtcagactggtcttgaactcctgacctcaggtgatccgcccgcctgggcttcccaaagtgctgggattacaggtgtgagccaccgcgtgtggtcatctgtagctcttttgtacgacttttactaaaaggacctgggcagatatattagttcactcttgttcttgaaacctattttgttggcattatggagaaattattgctggatgttacacagtgtggagaaaattgaataaaagttcactgggaagggtcatgatctattttggccatttaagtatgtgaggatatatttatctttatgaaaataaatttgaaagtagaaagaaaaagttactcataatactactagtttaacccaacggttacaattttatgtcctcttctgatcgttttctgtaggcatattttacatcattataatttgaatgtccttattgttttgtattatttgactttttatggcagcttactgtcgccttgctgggattcaccataatttacataatctagccaaatcatggggagtatggattttggagtagcaagagattatttttggagttagattttataaagctttggccatctgcaaaaatttgaaccgtatcctaaagacaagagaaagctttgaaggtttaagggaaaggatggacagagagaatcgcatttaagctccatttgaagtagagttatttttattttttgtataattccttgctttttggaatgtgtgtgcttcatatgcagaaaagtagtttcccgatctagactgccatctctttgaattccactgccacatctgtctctcttagttttctgtgtattttagagattccgtcagtttaacctgcctggctgacaggtggtgtcccaaatcgaaaccgttttttcccccgaataaagtgtgcccgtgtagctgtacagatttcgtcccctgaaaattcatctgaaatctcaattctcctgaggggagcaattaaggaagatacatgaactctcccctcctctccatcctgtcaggtgcccctcttttttgatggccccacctctgtctagacaaccctgacagtgtagaagtttccatctcctttccctttccctctccatgttccctccccttcagttttttccccctcccaggcgcttcctgcctggaaacaaaagattggtccccagtagcccactcagggcgattttagttttatgctcaccatctgattggcctaggtaaggtgcagagctcgggtgacgtaatagcagagaagggctagggagcggttgccgagcaggggctctaccgcgggcgggcagctgtgccagctaaccgtctgggatctcgcactgggggctgcagcttttccccgcctcgagccagtgtgcgggggcgggagaagagccagggggagcgggctgggcccggggctgcggctgcggccgcggggctgcggctccccagccccgccagctggagcgctcggaggtagaggaaaggtcttgacggggtggctggatccgtggcaggtaaatcccgcgactaactgcacccgggctaccgcgggggagggggtggctgttggatgatgctttaaggctgctgggcagatgttctgcctttccggacccccctcctgtcctgtttgtgccccagcctcgagtctcctacgtggctccccggagccctgagaccaagcgagcagtttgcatgatcccagttcgcggacaagtgggtgtgtcagggccgttcccagagggccggggctccttcgcttggtcaaaccctagactcgtttactggggcctgggccgcttgaggcaaaacccgccttgaaagctacgtcagcctgtaagtcttccctttcacccccccgcccgcccccctacccagccccagtagctgtgacagcagttccctagaaaaggggagggggtgtggccacggtctggccaagtccggggtagaacccccccgccccttacacacacacacacacacacacacacacacacacacacacacgaggaaagagaaaaagtgacgattttcttaaacgggcgccttcccctctttcttttatttttctttatccccctcccctttttttggtggggggatggtaataacagggggacccttttcttctcctgtggggattggaatgatgcaataacgcccccagaaagctcagggtccctggattggccctctctttgtctggggagcagtgtcattgggtccactgcctctccttctctcctgttccccttagctcgctgggggacattgccctcagtttgtgaactggctctggcaagattactgccgcacttttgggtgaactgaacattttagattcttactctggcaagttttccttccctaggtggtggttaaggggtggggtggggtgggggatggtgggaagagggggatgcaggcaaggagagagatagaggccccacttgtttttttttttttttttggtcccacctttcagaatccagttccagattctagacttgagggttctgggctgttggtctgtagaagcgaaggagagaagggtgagtggcttggctttgggaagcatgatgggggcggttgcagtgctatttttaaaaaacggctttcagcagggaagcctttagccatgttagtcttgctcccctcatggttttgcagactcaaatccaggccaagtgtatggctgtctgaggtattggaacagaaggaggtccattcctgttggtgacaacaccgtggccctgttctgggatgagcaaggtgtaaaggtcagtgcggttttcactgggccatttgcaaaattataattgggcaagatctgtgatttggtacttgaggcctccaatcaggggcaactttgggcaaaaagacttgatatggtaatgaatgactaacaggcagaggcttggagagagagccatttgtaagcctctgtttctggatacaagtgtcatatcccccagcccatgcaagaagcaaaatgggaagagactaggaggtagcctgggcaagagctgacagctgagaatcctgaggtcagagagaccttaggatgtcaaggagctgaccctgcaagtctccggacaggcagctgggccttgtaggagagatctgacaggaaaaggaggttcacatgcaatagggttataagctaggggacacaggaccctagggacattctcaccagctaaccattcccacaggttgcagaatttcctggtcagaggtggaaatggtatatagggcaaacaagtttgctgaggtcttgggagagggtgagtggtggacataccaggtgagggaaacgagaaataaaaagaactgcagggatgggaaggtgctgacatccgagagtttgctattatgtgttcagagactaagctactaaattaaggttaaagaaggtggccaaggcaaaaaaaaaaaaaaaaatcaggtgtacagatcagatgtagtaggcaggaaggcaggagcaaactagagagagagagaagaaaagtcgtggccttaccaacaacccaaaagccctgaattctctggtgagataggcaactctggaggttgaggcagctgtagctcagccaagaattagaaggatgattctagatatttaaaatcaacagcatccccacccacgtaacccaccttcaggaaccagtagctttaaccaagagaacaagaaactcaatgagcagcagcctcaacaactggctctttcctcctgggtaaggagagggcagtggggaaggacggtgcctcaaagggaagtggaggcgctatcaatctggcctagacaggtaggttgactgcttttacatgggtgggctggggcctggtctgggacccctgctcaaaaaaaaaaaagaaaaaaagccctccttctcaggatccctggggaccctgtgtgcgcagggaactgtgtaaaacctttacttcggaaggtaagtgcagcgttctaggcatctggggcgtacttaagcctccgctacgcgtcccccacccccacccccacctgccgggggctaggcgtttccctctgcagggcctggaatggactcgtctgccaagtcggcactacacagcttctccagcagggggcggaaaagggcctgcagcgacgcgcaggacccgagtcctccatttcaggtgtgatgcttcagcctcggatcaaataatagccacacatttaaaatctcatttagggttaccggagaaccaaatgaacctccgggtgtggcagtctatttccatttcctcccagatatgcgtcgcttcctaccgcgctctgtggctttggaaggcatttgcatttacctacgcggtgattatttgagtcactaatacacacagcctaaccgggggtttaattggaaatgttaatcagtgcaatagatctgtgtctgatttccacatttggtcagttatctgcaggttggagcaatctgtgctaaacccaggggatgcaatgaggagcaaaacggtgcagctacagctgggtctaagtctgggaaacataatggggagatggaccttgaaaactggaaagagagtaacaatttactggtgggaagaggaaatcattagaaaggtgtagtcacagagaggcctgattgctgagatggaataggatggccttggaacccacatggtggagagggaggccagagtttttctttgaggttggagggggctgaatttggagagtgaagttttttaggggccaaaggaccaggaactggggtggaatgaaccctgggagtcagaagtcaagtgttatggagggctagggcctggtctgggacccccaaacacactgtcccagacagtgacagtctgggacccctgttgtgtttgggggtcccagacagtgtgtttgcccctctctaggcctcagtttccttgtctttcaaacgatgaacttggcactagttgttctataaggtggtccatttattcttggtaatgaagacaggtccactaaagtatagccctcttcttcccctgtcagaaaaattaccccttctttttttgtatgccctccagttttagggaaaacaatacaaaacaaccccacaaccacatatatttcatctctttcaacagtgtggctttacttttacttcatgtgaatggggaacaggagggaaaagagaagtccaagttaataatctgctagggaccctataaccaagcccctgaaaggttctgtgtggctgggtctcacagacctgagtggatgggtgggtggcgtatattcactagtggcccttactccctaactcaatctcaaaacagaaagtcttgggatgaaggtgaaggaagggcctggcttagggcgtatatccttctccttcgtgccctcctcccatatctcactgtgagccccaggcactttttggaattcagcaccctaaaagaaacactatccttaacaatcagcacaacagtgccctctagtgaccttaatggggacaattttaagagctccccatgcatccccggtcccagcctggtcaccagtgcccttgtgcagcggttactccttgtggagaaggctcccagtccttccaaccagcctgacagagaaactcagccagccaccgtttcctgcaagtccttctccttgcatatatggatggggctgggggttcacagagggagtcagctccccacaacttcctctccagcgttgtttcctttgggcctgaaaaaggttccaaacctcctttcctagacagcttcggtgctgagcaagatacttggcatgggaaggctctgtggtagacagagtagttgtccatagcttccacctacccccaccgccaaggtggcagccctagtccccagacagagattctgtcaggaagttggaatgcagcaaggtggctgggggtggagttgggttagtgatgggtattgggtatgtacaagatgtgtgcactgatttctacctcagtctccaacaggaggctgagccataggtgtacaacaaggcggtataggcatacaacatgatgtaggcacacaatgcccacaacactatacagacacacaacatggcataaagatatgacacaatacgaattagacacattgcacatacacaaaggatggaagagatgcaattcacatgcaacacagtacagacacatagcactcacacagtagcttattgacatgatcacgtatacaacatgatattaacaggacactgtacacacacacgatatgatgcagactcaatacatgcatgtcatggtagatatgacacagcacacatacacagacatacaacatggtacagggaactgtgcagatatacatgacccagtatgcacatgtgctcacacacaggatatctccccttgccctactctcaacacaacacacccccaggcaggtgagaggagtgtggctaccaggtggaatactgtgtcctgtcagttgattctgcactgactcaagcaagtggtgaaataaaggcaggttgccatggagttaaaaagtggtgctacaattgaggctggggggagggggaggtaagcttcaggaaagctcttgatcttgctctaaaacatggaggttcttggtagtacaggttgggggtgtgttctccttctcttacatcctctagtattgtttcccaccccagtgggtggatgctgcctctgctgtctgccctcatccccagagatgggcagggggcttcttgaggccattcttcctgtgtcctccttgagccccacccctctctggagctttggcagcttgcacccctctccccctcaccccaccctcttgcagggtgagctcacgtagggagggagggggcgagtacaccattcaatggtgcagtgggtgggatttggaaaggctgcctggagtgtgcatgtgggaagcacacatggaatgccagggatgctgggggacagacatgctctggagtcttgcccaagagcaagaggcagacccagagtatggcttggagttttaattccagaagggggaattggagatcatggggcttttcttggctccctaaggcttcaattttgcaatctccgtgtttagatatccatctagccatctctttggattaggaccctgttcattctggtctgtaataaataggtgctagcctgaatcatgcctccttgagaattagcatgtagtttctgcttttctttgaggacaaacaccactgtgggaaggggaaaggaaagcagagtaggaaggattgcagagcttggggttctacaaagagaagatcagcctctcccttgagaggctcaaatgattgtgggaaaaggcagaaagggaggggtcaaagagactcagtctccttcatggttagacatggaaacctctgtgggaaaaatagggtaaattatcaccaagcaacaacagtaaacagtatgtattcatcctaagaaacctggggagtactgtggaagacttacctggtggagacaggagaaggtagagggaagctccaattagggtcagaggctggggccttcagcacctgtgagatggtagcaaattaggagacctcagaatgctgttgcctggcagacagactttttttccacttctccagtgaaagaggttagtgaaaaggggaatggaaatggaggtggagacttagagttgagggatgaactgaactgaactgaatgcagtgccacaacatcaggaagctcacatattcacagagccaaccttcattggccattgtctctcagtttccttttgtccactggactctaccacctcctgtgattatacacattgctccataattatgcagactatgtaaatatttcacatctgtcctatttgatttagttcttccaacacttacccaagtcaactaaggcaggccttttcacttgatactaagcaggcccagaatgatgaggtgactaacagcaattctcagcttgtaactcccaactcctgactcccacttccgtgccctttctggaatcctatgtaacaatgcctttttacacttcttagccctctgattttctagctttcttaagagatattctgaaattcaccagagagattgagaaagagagagagagagtgtgtgtgtgtgtgtgtatgagagagagagtatgtgtgtgtgtgtgagagagagagagagagagagatgtttggtgggagttggatgagggagcagtagcaggtggggaaagaggttccctctcccctacaatgcttctctcagcaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggtgagtaatggagtccagggcagggagttagggatctccaaatccaggcaaatgctgcttttccaccagatctcccaatatcaaagactctgcctagacctcgtgagctaggcctcagggcatgacccctatgttctggggaattttgcccagtacagctgcctttagtctcttgcctccctcccatctctaatatgggaatgacagccttgacctacattttggggtgaggaggagaaacaacataacaatcgttgccaagtccgttgcagatgtcaagcaccatctaagagcttcagtataacacagacatgcttcccatcaagctgtcattttcttttctcctcctttcctggtgcctgggtggcttttcagccacatgctgcaaatttgccattcagttcctatgatttctactgccccataaccttaattttaccttcctgtttgaagtgtacccccaccccttccatccctgcttctgggcctgtcagacttagcttaaaccttcccaaaccttccctctgctttcccacccaaccaagatgcacttcctccaccaggtctccaacagcacttgagtctgtagcgtgcagggtagcacttgctgccctactgccttaaataagtcttgcatggtttctggagtattcatcttaccaggaaaactagattgtaagctcttcaagggcagggactagatcttacagatctctagtctcccttaaaagggctcaaaagttccccagcagctttgcaagttgggcctctctctcttcctctgcatttctttcaggtttcatggcctgtctctccgatcatctatttgtttttttgtctgcctttcaggcaggcattataacttcttctgtcagcttctccatctggcctctgttgctattccctgcagtccagctacctgcttgtagcttgctgtccctctgtctggtcttctgtctatcagttgcttaggcatctctcctattacccaaatcaaaaaacaaccaacaaaattaaaaaaaaaaaacagaaaaactaaacaaaaaacaagcaaggaataagcaatgtagttccctttcacactgagcatacaatgcgcctacagacaaggtaaaactgcagctcagcagcaggtgtttctgtgatgccttcttatgaaagggaagctccagagtttcagccatggaattgaaggtatgaaattacagccttgttgatactgatgcattcaactttctagcgatgttctggtaggggatcctctttaggccttgacggacagaaggtaactaggactgactaaaatgagaagcccctgaatcgctctttggtgttctgtgacagatgcaataataacttgtatttattgtctactgttgccagctctgtgctaggctctttactggcatgataccattttctcctatgataatcttgcaaggtaggtatttttttttctaatagttattgctgtttctgattatacaagtgatactagctgaagttaggtattatcatcattactgttttaccaaggaggagatagaggctgagagaagctaagtaacttgcctgtaacagaagacatgctgtggctttgggaagaaagagacttcctggagagagtttcccagcatccaaagttattttggtatctttagttcatgcacatacacatacatactctcacaagcacattcttgtactcttgtacattcacacagtcacatcatcccctgggctcactcacttttcatactggagtcattcaaaatgatgatcactcttatgccctcaccctcacacacaatcatatttacatacatgctacatttaggtacattcacactgccacaaattcacattcacgtattcacattttcatattgatgcacacaacacacttaccatacaccccaccctcatgttcacagacactcacacctttgtgctattaatatcatattctcacacacacacacaatcatacactttcacacttacattcacacagaggatacaatcacctttgcctgcccaaattcctgtatagtcatacatactctatacacaaataatacattgacattccccctgcacacactccaactgtttcttatactcacagccattcatacactcaatttcatacactccagtgtacttgcattgatgtcatcactgtttcttcctcacagtcacaaacttatcacagggacacaaacgtgcatacatgctcatatatccacgtttatattttctcacatcataagcaccatctcacccacttgcacttttacacttagaattacacacttttgcattcacatacacagagctaaaacaacctccctactcctgatacattcacacataatcacattcatacatagaaacacacattttgccacacattcacactcacacactcactttcttcacactgagacatcatcacactctataccaaacttgcaggcacatacactgaaatacaaccatacacacatatttttataaactcagccattttcactgaaaaccgtcactctaccctctcaaactcaagcacaatcacttacacacacaggtatagtcacattgactgacacatatataggcttattcacattcagtactcatacaaattcacataaacatacatactgcacatgtacttaacactcacatattcactcactttcacattcacgactgtacactcaaaattatacacgcccttattcccacagacaagcactcctccacattcgtgtacatgcacatgtgtaccccctcacacaccatcccccactcgtacatcacacattttcacactggcccaatcacacttaccacacactcacattcttatacattcccactcttctactttcatactgacacacccttactcacttcgctacacacgtttgcaccagtgcacatataatgacatgcacagtcactgacttgcattcatgctagcacataccacactgacatacacaattcacattgcaatagttgactgtgcttcacacaggcaattactgataccacatatgacaacatagactcacactcacaatcgccatgccacattctcacttacattgatacacttacactgacacacctgttcaggaagtcaaacactctcccgtaatccaccatgtactcttactcagactctcacatgaacacgttgacacttaactaccactgagataatcacattgacccacatctattcacattgattcacacatactgctagtgacccacactctcactcatacatactttcccaaactcttacacatccccctcccatcccaatagccctgcatttatatactttctcactgacacacacacacggatacatctaattgcaagaaatagtttatattcacagttgtctcttttttctttgtttgccactagtgctctcctcacccctgctgaaaggttatattggcaaccagttgccagaggaaaaatgttggtctcatccaggaggtcaatgagaaatagatcctttcagagcagaaaggagtagaatttatgtctaggattaaaaaagaaaaggctcaaacccacagatcaagttttccttatcctttccacatactttttcttttttcagaaatcatctccaatacagccttagccagtcctgtccaacacaggttggagtttagatggtgtgtttattttctggaagtttatggcttaacttgctacctcatttctttcctatagtgaaaggaagatgaaggatgtgtttctttatgtgctgttaatggtttcttatgcaaaagtgcatgtctctggttttatatttatgatctggaattgcctgctgattacacacatggaaagggcaggcctgcttccaccaggcacctctaatctagccaggtatacttaataccctgttaaccctggaacatggcactcaaggaaaggaaagagaaggttaatgaactagctggatgataaggtaaatttgtactgtaagtgttcatgtgcgatagtagaccccactgaaatttcaacagctgttactaacaagttacaagaggagatttttcagtaggcgtggataaagacaagctgaaggaagtttcttgcacttcagaaagactgtagatttccctgcaagtggataaaaagaagcacaaacccaggagtgaactaatggatcaggagcctggtgcaagagtcatgtgccaacagagatttgaaaacacaagagcatcttgcaagggtgtctctagtacatggcttctcctgctggagtcaccctggagcaaaaaatgagttcagaatatacccaagctgccatttggtatgggttctagcatgccttagggaagagcttattctctggaatataacccaactccctgccattagattgagaacttctttgatagcaagaactatattatcttactcattttggtttcttgatgcctagtgcaatgctaggtccagaaaagctacttgtgagactcagttaagaaactaaaggggatacctgagcaggaacatcttatcaatacagacccagtgtctctcttcttctcttcctcaatcccagatttgcagtggcattaccagctcagattgaggattgtctgtaggccccacatagagctaggcccagagattcaaatgggtgaaagacacacctattgcactctaaggtactttcatttgtgtgggaaagatcaagttgccatgaaacagtagtatgaggcaacagtctggaagcttgggcatggagggatctttatcatgaaatccagtggtctgtaggctccaaaggtcttgacggttcataagtagttggggacagcagtcagaatttagagaagtcactttccaaagtaaacttccttgtagatagcttgcttagcacagggctgtgccatattcccagaagattgtataacagagtactctgttactgggcctaaagtggagtaataagagtgatctgcagaccttagtgagattattgtacttattaagatctaaccaccacctcctccaagagacagcttaagacaggggttcccaaactctggactgcagaccagtgctggtccacagtctgttaggaactgggcagcacagcaggaggtgagtggtggatgacaagcattacttcctgagctccacttcctgtcagatcagcagcaacattagattcttatgggagcgtgagccctattgtgaactgcacaggcaagggatctaggttgtgtgctccttatgagaatctgatgcctgatgatctgagatggaacagtttcattccaaaaccaccccattgccccatgtccatggaaaaattgtcttccacaaaactggtacctgatgccaaaaaaggttgaggactgctggcttaagagaaacagctgggcaattttacatttggaaatttttggccattacttcaagattcaccaaaggcaatttatataatttgcaggactggctgaatattaggaagagaaaaatgcacctgcctgagtgtgcttgaattcagtgagaagcactgagaaaacccattcccaaacccatcatgcatttatatgatattttatacttttaaaaatgtttaataacccattcttccatttcaatagaggtgttaggagcaccaactctggtatcagccagaccaccatttgaatcccagtttggccacttcctagctgtgtaaccttgtttgagaaattatccccattgcttcttaggccttttggctaagatcaagtgaagagaaattacttatcccccttaagcctcagtgtccttatgtgtaaaatgggaatgacactaatgtcatctacctcatggagttgttaagaggatgaaatgagataatatatgaaagtgtttagcaaaatgtctggcttatagtaaatgtttgacacagtatagagcttattatctttaccatagccctttgaggtaggcaccttcaaagggacagatccttgacataacagagaaacagtatggttctttgcagccaaagattgattttcacaggacttgttgcctgttttcctttaagtctttatttctgcctagccacaagctaggtgtcagtattcattcccactcaagacgatgagtgaaaaataggattagtccatggagtttcctcaactactgtgtctctttaggacatgtttatcttgcagaaatgtgtcctgttcatttagctatcccctctagtcctacttccacccttgaaatcagtaaagccatcagtgatgccacctttatttgccagtacccaaacttgtgggggtggtgagtagaagagattcctaatgtaggtggaaccagcaattggttctcttaccataggcattcttctgtccttgattctgattgttgaaatgtctgttttgtgggtggaagatctgctcattttcaggctttcgtcccaaacgccacagtggaagcacagtttacttacgacaaagccctaagaacattcatgttcatgtaaaagctgtgagtaactgcagaatttaatatgaaactttccgtgacttaggaaacagaaataagtgcacgggcattgatgtcacatagacatgggatggtataatcttactattacatttactagttctgtgaccttggtcaagtgacttaatgaatgtgcttcttcatatgtggaatgaaaatactgtaataacacctcaggggttatgcaagttatgtgaacttgtacctaagtaacttttagcagagtgcgtgggccatgataagatttcagtgaatgatagcgattttgtttatggcttgtgaaatctgtgaaaataaactgtaaacatctattggtagaatgtcttgaattacttcaaagcagttcccaaatgtggatatgtgatcctcacaatctactggtgacgtgatcaccctttctagatgaagaaatagcttcagaggggtgaagagatgtacctaatgtcacgcagcttgtgagtggcagtactaggcttagaaagcaccagttcagatgattgaatatttgcaccttcacttggtaaagcctttgggggctacagttagcaaataagaacaatttgaactgagcataatccttcttgtgacaaaaatatctaaatgtgagctacagtttatctacaaatcgaaccataggtgtttctctttgtatcttgtgcaatgcccagaatgttgcaagagtgaaacaaatgtgacatcataaatgtttggaaagcagtacctttccaaacatagctgagtgacatagggccacagtagtaccattcaccaccaagaggaaaatctttcttgaggcataaatactgtgtggttctgctcatgttgctccagtaacaccaaatgttcagagtctgggaattcttaaaacatacggagacacttcaacagacctgtggtgccacttggccatttctgtcctgacatgagaattataagacatcaagcttagtaaacgttagggagaggatgggaggacaaaaagataggagcacttttggcctttttgtaacatttttctcatagccaaacattcaccttgaagcactcttctcttggtttctatgacaacatatcagttctcccgcctctttgaccatctttctcagggatcattagtcactcttcctcttccaacctctaaatgttggtgttccacagagatctggtctagtcctccttctcattgtgtattcttcctgagcaattgtgcatattcccatgctgatggcctccaaacaaatatcttcatcccacatgtccagctctccattgaacagtttcataatgccaaatgaatgtgttagaaccactgctacaattgtatctgtcttaatattgctatctctgttatgaggaatagatatagctagagatacagtttttccaccacatgtgaattgatgtttccttcaattattttattacttgccatgtagattatacttttcaaagacaagatgcttagatatgtgtcttgcttcccactagatatttctagttaagtttttactgatatttctattgtgtcactggttttatcctcttatctttgcctgttgtagtcttgatagtattattatgtttgttggtaaagtctggataaaaatttagatgaattttctataaaacttattataagtgccgttctattggccaaaaatattataataatttgttcttattctctttagagtgcaattattacaggtggtctaatggttgctaatacaagggacttccaacacattcatatttgttatcagcacactaacttcattagttatttttcatctccattctaagctattcggttattttcatttcacaaacatggaaactgaggcacggttctatttggaatcccaaatgtaaactaaagcttgcaaaaaccattaggccattaggcctcccatactcctctgggcctcttggcatagaaatatatctctaccctgatttccatttggggtcctgagaacagttaatcctatcaaggctggcatctctaccatctttggccaatgtccactgtagagacctctcttgacatctctcttctcctgtcttcctattcccatgctgcatgtgctttctgtctcttgactgattatcttagtgttgtcacttttcaaaatgatttccatgttcctacctggaacatctgactccataggaaaaacctttcccaagtcttcaaccttagacatctgctacattgtcacctgagtaatagttctgaaattcaaagttaatcatgctatctcaccacttgaaacctcttcatatacacaagaggagtccaaaccttgtagaaacgcatattaaacccttcttaattcgtctctatggatcttatttttttccattcctcttttttgtccctaatctccttaatacacgttgctgcttgacctgaaaaatggtgtggttaattgttcttcctaattcaactcgactgtacttcccctgtgaagcctgcttcgtcaggctccagggagtctctgtctctgtccttctatagcaaccttttctcatctttgcactgagatgtcatggctgacatccattatattttaagtctcttcaagggcggggtcaactttgttcatctctcaccctagaacctggtgaactcctactttcctttaataccctgttcaagtgctatatcctctgaaccctccaggcaccattagctacccttcttccactgtcctttcaaagcatccaatgcctaccttagcacataatagacaccatataaatgatgaataaatgaataaatttaagaaggtttaatgatttcttcaggatcacagaaaaatccagaagtagagctagagttagtcattcattccttctgttagaaacaattcttttgggtttataaaaaatctactaaataaaaatcaaccccccaaattaagtctgcctaacaacatgcaacttagttcttaaatgtaacatcgaaggtaagtttctttttccgagtgttatgtgcctaataaatttccccaaagagatctgtcctgcttatatatggatacagttctaaaaatgcttttaggtcttacacatattattttcttccagagttttgagatctattcttttacttatacagcaccaatatcattcagtccagcagaaacaggcccaaggctaataaatctaatctagcatgcttgaagtattcattggttgaaatatactgttgaataataataccttatgccaacctagtgcttcctacctttcaaatcctattgaattcctgctcatccttccataccctgctcaagcgctatatcctctgaacccgctgggaatattagctatccttcctgctctgtccctccaaagcatcttgtgcctacctagattgtatcacactgtattcttattgtatatatgcatgtctgccttcctcactagactagaagctctttgaagatagagatgtgtctttattcttctctctttgtatgcttcctgtacctgacataatacctagtatatatgaatgttggtggtgggaggatgtaaggccaggcagctatgttccctggaacaatatcaaacacattccttgtgtgtggtagtatgatttcttatatagcaataagatgaagagagtcttgcccttttctgaagtgctgtagctcctctttttaaatttttactctcattttgcaatgcacatatccttacttgttttgtagttctatttttgtctgtatatgacatactttttttaaattatactttaagttctagggtacatgtgcacaacatgcaggtttgtcacatatgtatacatgtgccatgttggtgtgctgcacccattaactcgtcatttacattaggtatatctcctaatgctatccctctcccctccccacttcccccaccccacgacaggctccagtgtgtgatgttccccaccctgtgtccaagtgttctcattgctcagttccaacctatgagtgagaacatgcggtgtttggttttctgtccttgcaatagattgctcagaatgatggtttccagcttcatctgtgtccctacagaggacatgaactcatccttttttatggctgcatagtattccatggtgtatatgtgccacatttttcttaatccagtctatcattgatggacatttgggttggttccaagtctttgctattatgaatagtgctgcaataaacatacgtgttcatgtgtctttataacagcatgatttataatcctttgggtatatacccagtaatgggatggctgggtcaaatggtatttctagttctagatccttgaggaattgccacactgtatgacatacattttacatataatgtgtggccaggaatgaaacccactgctggagcctataacctcactcagagctagacacttatttatctgcttacacccatcacttagtatgatgcctagcacataggcactggtaaatatttgtggttcaagtaaatgaattcatgcacagatgggttacttaaggggcctcaataatatattctcagttactatctgtcacctcaaagagtagtacctctctgttttgggctcaggattttttgaaatgaaagtcaaccagaaatgaacaaggataaagcattagttggtatattttcctgtaaaaaggaatgttgggctgacataagatcttttcctctctttatgcagctgtgtgacctatagaccttcattattaagctgtgcagaagagtatagggcatgcctaggtgatctgctaaaggccacaaaaccaactggtgattgactggcataattgggagtactatgacgtagaggatttgtcaggctcaatcttgaagaaaaaagaacactctaagatgagcatcatttgatacagagttatatacatttattatgaacacccgagtttcctcccctttctctctgcccagtgcctttgtcagaatgtgctctaggctacactgcagtctccgcaggaatgagtcaagaactactgactgatttaccctcaggcctgctgattacagctccttccaccaagccctgcttctgttttatctgcagttttcctcccaaaataccctaacttccttcttgtgtggtaagggctgggccctgtgatctcagcttgggggcttcccaggcccacagaaagacttaggcacacagcagtctttgctttgtatgtatatgagcactagggaagtaaagctgatcttgtgctgtggtagacatctactctagcatgaactaaagatgaaccatatattctataagtggacagcagcagctgcaaccaggtagtaaaataataagcattgagccacttgcaaattatgaacttgtataagctgggcatggaaaggccatgggaaaaccaacatactcaatcatgagttcgtccttcagatcaggcttttaatttctaaagagactgctttgggtgtattataatcttttttaaaatacccatgccagttttctttaatgcaaaacatttgtctggtgggcttgaatatggggaattcctacaagtaaggcccttgtcagctaaatgtttatcccccaccattgtgaagtgggatgggtagaaagtaggttttgtcatgtttcattcttccttcagtatttaagaaagcctgtttttaatagatgttatttcctcttccttaaccatagctcccaaatgagatgtttaaatgcatgctcagtataataataatgaaattaaaaaaagtatgggcatgtaaacataggtcaaggggcaaaaacttgaggaagtgttgctgcattttacaccagttcaaattctttaacttccatttctggcaagaagtcacttttttggtgaactgtgagatttgctaaattgatctaagttcctagtttagaaataacaccaaatctccattgccccaggtagctcttctcttcagatgtgaaatggacaccttccctgtagaaagctgatttgggtacagagaaattgggaatagagcaaggacctaggatgatgagccatgatgcacagtttgaaaagcaacattcaggcacctctgtggtatgcaaaaatctctaggaaattcaggaattgaatttccaagcttaaatttgaggacatttgttgatatttcactggggtggatcaataaagagtataattattatccatgcatagtaacagagacaatcgagacccccagagactcaagacattggtttgccatgtcctgcttgcttgggatgttaatctatctaatttgttccatctgaatgcttccaaggatgttatgtgctctgagaactaggaaatgttttcttactaagttttgcttctcttttcttttttccaccaatttctctgaggcatctcttagggtaattacttttgttttttatgcttaaaatatttctacctctattctttatggatcttattttctctttttagaagcatcaatattggaaacaaaaagctgaaacctgtaataatgcatcggtttgcaaatataagtacatgtaagataatcattagcattttctgggcattagctcatgaagcacacacaatgaataataaagtatggtgctgcatatgtttagaggcttaagaagtcatttgaaaaataactatacttaagaaaaagaatgattttttccttatatgcagtatatggagtctggatgctggattatacctattgacttcctatttgcaacctgacgttgaaatttgcaactataatatgctggcttcttggactcaattaatgtcaagttcctgctgaaaacaatggaagtcactcataaaaatgttagcagacaacaatactacagcagaactgacctcatttgcttgtttgtatgagagagaacatgaatgtatgctgtgtgagtgtgcttgtatgtatgtcagcagtgagctatctcttacatgatctaagattgaaactaggtggctgtaaaaagagctagtgcctctctttcttgtctggctgcttttgcagatctcctgcctaacaagtagctcagctccttctgatcaaatgatcttagaattggcttccctccattacacactgtaatggtatctccctagtgaggctctctgaaacagcacacccctgtctctgatagcagagttcccttggtgagtgctccagaagaggcgagctccaaaacgaggccatctaagaattggtacaactggccaacgaaacttgttggagtgttgtcagtaaatcacctagccttgtgtctttaaatgggaaaagccatttgaaataagtaagtaccagcatgaagtgggttgaaatgaatagggtagacctgtcgtatgaatattttaagaggataaaaatgtatatatgaagagtgtgtttgtgggtttacttggatatgcgttgtattggtgtactggaaagggaactgatgagtttaggagctgagggattggatactattctcagttttttcatttgtgaccttgggcaagtacttaaactcaaagcttgtaaattcctcatgtaagaaatggagatgatactttcttcttcgcaatgttgatgtcaggctcaaagaagagcaagacgtggaagccctttggacattacaaagtcatatgtttttaaaatgaggtgttggtaatcagatggtagctggctttgaaatgatgcctaactacttggcagttagactagtgctgatatttccaaatatgctttcttgtctctgacctgctacaattaggtctataggcttatgtaacattatgaaaaacttactccaagctgtaacaaatacataggatgtatagagttccattttgttactttacacatgtatttaatgcctgttggtaacaagagactgtactagtagtatgaaagtgtataattacgactgaggggctcttaccctcatggaacttatgatctaatgaggggagtgacttggataatgactgtgcaatttgagacaagatgatacaaatggtaatttgggcccatctagctggctatagttagtggttgggctgccccttttccacctagtttgggaatggtagtgtgggttcagagctgctaggagacccagatctggttcattcttctccctgtaaaatgcccgctttggcatcttagtatattatgggcattaatgtctgaaaagtcactagaaatcttcagatgctagttgctgtagaaatgcaaggcaacgtataatatttctttcaaatcctaagacattgtctcctttgtggaaggctagatgattttttctttttttggcagttaaaaatgttcactacatcttcttacattatcagtcataagtgaggtggttggttcttttgtaaataacgcatctaagataaagtggatttagtatcagcataggctagttagcaaagcatggtttgtttcccagtcaagtctatgcctgaaagctcagctagccatctcgaaaatgtatgcctttggttaaaagagagcccaagaaagagccagcagttgtaactcttggattttgttgcccaccaccaaaagtacaattcagatatatatatatatgtatatatatctcagattaggaaattcaccttggaaatttctcttagtgaacagctcagtcctgtgtttgatcctctcatttgctatgaaaagggcgttaaacagccttggtgtgtgctcagatttgtgataatagccttgtgtggctggtggttttggagattttcttctgggtttgttagatcatgactgtacattgctaacctggggttttgtttttaaaaggatggcagtgttaatttagttttcattggaaaaatataaaaataaatagttatgtctaaatatgaaatagttatgtctaaatatgaaaataaatagttatgtctattttgaaagcagacagaataatacagacattattattctacagtttgcaggaccatctattaagccatgagcaattgaaataaatatttttatcagatatcataccatcagagaaatagggctttactgcaaagcattttagagaaaaaactattaccaagatgcatggcaactatagattaataaagctctgtgtcaaggcaagttaatgaaggtcactctgtatgtgttcttgtgtgcccctgtgtgtacatgccttcaaacttgtgtggggagtggggagaaagggagagagaaagacagggaaagagagaggtaatctctcctagtactctgaagaaaaggggtatttaggctctttgcctatcatgaaacaagaggcttatgtcttattgctgatgaattgcaagtgtaattacagagcattgctaaaccacattaagtcccaagggctgaataaaaaaatatacaccatctacaaaagccatttaaattatctctgaaaaacctagtagtcaagtatgaaatcagtctgtgagcagatataaaccattgctggttatccattaaaattagctccacaatgctaagggccagtctctaaaagaaaaatgaatggcctgtggctatatctaatgtgctactcacaagtttctgtactgttacagaaatgaacaacaacagttgaactttaaagataaacagttttttttatcggattcctagagaataatggtgcttatgtacaattcttgaaatagagcctacagccgcccaaaataaaatagtctctttcaagatcttggaaataatgacatcataggcagattgaaccagcaatccattaatagtatcctttatagaaagctgtctcaggggaacacatggctaagtagattggcattgtttataaacataacataataaaatccctttttaaatatgtttgtggaatagtaggagatacttcccacttgggaaacaaatactttaaccacaaggattccttgcaggtccctaccctttctccattggtcttctaaaagtgtgcttagaggcacttgatttgaaggtgagttaaaataccaaggacctcctgtactattctttcaacagcaaagcagaattatctggaatcattagcagaggatgattggttgtgccttgtaatgggtagtaaagaaccaaagtaatatcaagataattaaaacaaaaccatatctgaactgtctaggaaaatggtttggttcaagctttattaagttcctagtgtggacctggacataggttcttcagtttcacttgtgtctttgtaaaaggtgtattccagctcctcttatgatgccttgattagttgaatgacattgaaacacttccagtttggtgggcaataggaatgtatgtcacataagctgagtcctttgcagaatgtctgtgatactgaccatggcaaatgtgtgttattgaatttttggtcagggatttttagtgcaatatagaagagtttagtttgagttttagatcccaagtattcctttcttcccaacccatattatacttggtcaaataaagtcagggtaatcaggcagcctgaaaggaagcagggcatctacctgcctctctggtcagatggagtaattaggaacaaaaaaggccactctgttgttagccacacctatttatcaagaacaaaggagcatagcattttaaattcatttgagctgaaaccctggctggctcagactcttacttgtcttatcacgcaagatcagctttgtatatcattttaaagaggtcgtgtggcgtgttttcctgacttctgtcatctcaagttaaatatgtcatcagaaaatatatatcatccagaaaatggtggctctctcttcctgtgagacactctttttagaaatttgtcttctaggtatttctattttaaaatgttcagtttctctgcaataactttcaaatttcattatttttaccaagctagattttgtatatctgtatacatatttatgtaataatcacttcatatttgcacatagtttttgaacccagaaaagtaaaagagaaaactagtgacttgtctctggtggcaaattttctctgtgactaaattaaaaccatgaacctgtccagtacagaataatgccactggtgaagtcagtcttaaattcactttaattctagagaaactgtgaatttagaaggaccaaaagtcaaaatgcaaaagataatgcagacacattagcactggtctcatattccagttcaaatatttactctagtaccgatagtatctctgaatatactttatccttgacatcacaattactttttcattgtaccttgttctgtagtttgacctaaataggaaaatgtaaggtttatgaaattgttggtgatagtgacaaaccatttattacttagtattttcactatcattattactgaaaaaatatagaattggtcttaattcattaagataatgcaagacatgacacttagcaaaacaaaagcgatctcccgttcaaatcaaaatcaaaccaattgttagttgtcaatcacctgtgcagatggagaagctattaattgatagtaacctattcttgagtaattacagactgtatatgtttgagagaatttagaacaaaataaaatttttaaaattctctacctaacatgatgtaacttagagtgcattactgagagtaataaacatactataaccactaaagggccggaaagcattgatagataatttttcagcacaacagttaatgagtagacccctgtttttgtttttattgttcttaggtttgttcatagtaaatgttgtggaaacaaagtgataatgctaagtcatgtttggagagttgtaatgttcctaaattagtaccaggtaatacttgataagtttacagagatatagttttaaagggatttgattttccttgaattcaaactggggattcatttggaaggtactattagtacctgacttgtgctggggtcaggaccttatggaaggacttgaattagagtaggaaaatacctggagacagaaacattcccttggggagttcatgcttttccagtttactttatcctcccaggggaatgaaaaccaaatatactcagatgtagacacaagatactaaagaataatgaacttggccaggcgcagtggctcatgcctgtaatcccagcactttgggaggccgaggcaggtggatcatgaggtcaggagatcaagaccattctggctaacacagtgaaaccccgtctctactaaaaatacaaaaaaaattagctgggcgtggtggtgggtgcctgtagtcccagctactagggaggctgaggcaggagaatggcatgaacctgggaggtggagcttgcagtgagccgagattgcgccactgcactccagcctgggccacagggtgagactccatctgaaaaaaaaaaaaaaaaaaaaaaaaagaataatgaaattcagagcaaataagctcctaaaacccagactggatcttacagctagctacctctgtcacctccctttttccttcttccaagacgtaaaatgtggcagggagtaaggttatggtgtctcctcgggaactggccctccaacatttgcccacctttatcttctgcctgcttgggagaatatggaacattgtttaccctaacagcacactccaactctgttgaaactgccagatctatgggatggtttctcggttaattatcataaaaacaggagagtgcattttgtgactgaggtacacacatgtaagaaataaacaccaaggacatctcgatgttaaagcagctaacaagtcattgttatgggccattaaaaatcaacagccaaacctgtgtcaattccaaactctgaggaggctgatcacctgaccactacaatcatcaggatagaattttaaaataagattgtaaattgttcactaaaacactgttagtggggaggagaaaatagagtttcaatgtgggaaaagcaaagggacttacatatttttataatatttgaaaagccattaattactgccttcactttccttttttgaaaattgcatcagggtttttgggaggtaacttccttccctccagaagagaaacccctaaaaacgatcctcacacaaaacctgagaaaacatgagagcaatgcttttgtttctaagatgttagaatccacatatttattaggtttttagacctcttctccctcaactccttttttttccctccttttctttaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaagtaaagtatcagtggccgggcattgaaaatgggctagtttattctttcattttcactttctttcttaggtagttgtttcttgaggattgactgttcagggcctgccggccctttacatctacgtcttcagaggttgcattttgtcagagaataatgtttgattgatttactgtgggctgacagaaaatacatttacactatgtttgcttttcacataaaattaaattcatagtgttaagccaagggtaatcatagcaacagtactgtcttgaatatatcaacagtgactttctttctgataatgtagagtagaatttacaataatccctccctaactataagttgttctttttggaaatttgggtataggtaggtttacttctgtatacctttttgataactgaaaattttgaattcagtatatgagaatcagtccacgttgccacaatattgtctctctgactatattgtaagtgggaaggcatttctgagtcatttgtttccattatcattcttcaacctgttttcccctagacagccccatgtgtactgagtagcacaccaatatattataatttatccttctggtgtttgtaataccatttggtgcttaaatgtcatatgctaatgctttgtgacgtgcagggatatgaaatctctagtaagtaactttcaggttacattaattagcataaagctgaaacatggcttctacagatatgaagcaagtacaagggcactgacaccatagaaacttgtcagaagggcaagaagggtgatgtctttagaagagaaacaggacattctcaatctacttcttcaaggtaaaataaatagctttgtaggtcacttatatagtgttaatcaatctacaattcataccacaaagaaagctgaaactattagtatggccagtactgccacttgtacacctgcataacttaaaagatgctttgttcttcatgacccaaggatggaaaagatggaaatgaagttaaatctctggattgaagataaactgaagaataatgaaccacattccatgcaagagatttgtgactatgcaagaggaattttcagagacatgtctttagacactgaaatgaatccagaaaaaaatttgttgggagtaagggatggtttgaggaatttagggtgtaccataatgtggagaccaggtcttatttgacagttatgccaaagaacaaacagttcctgcagctctcatgttgtattcaccacaaattcaggaagtggctgaagaaggggattacatgcctgcacaaatctttagtgctatcgagagtgtcaagctttgaaaccctttgaatacttctgaagagcaagcgcccactgatgctgaggtcaacaaaatcagagaagctgacatttccattttttgccaatacttcaggtgacctcataatgaaacccttgctgctctacagaaaattgtgcccaaaccctctcaggggaaataaatgagccaagtttccagtgtactagcaagcaaacagaaaagcccagatgaatcttcctctccttaagggatggtttgaacagtactttcttgtggatgttcaagactacttaaaagaaaaaaaaataccttgaattcaaagtcctgctgattcttcagtctatttggtgcttcaggtacatttgccaatatgcatcctcatggtaaggttgtctttataactagccacatgtctgagattcttgagcctttcagtcagtgtttgatctggccattcaggaaggcttattataaactaatgtataactttgttcacaatctcgcaaagtttccactgtctgaaaatcctagtgcatgagactcctacatcgttattaatggcatatccttaataaaagtttggcttttgatttttaatgggttttcaggagataacttcccaaagaggcattagatagtttaacagagcctgtcattaatgtgacctgtgagaagacttggctagaggtggtgaaatatctttcctctatccctcccaaagacaagaaaaacctatggatgaggatgaaaatttggcacaagagcaatcattggcggaagttgaatctgaaactgttgacaccaattcaagttaatgctgctagaggctgatcctcaggaagctttcttgtctccagaggttattatcataagtgatgatgaagacaattaggaggctgtgggactggaaacaaatacagcaataagaaacaggagcaaaatttttagaacaagattaaaacctccctaagaaggtaattaaaattggcatctttacatgtgtcagatattacctgttcaaaatttgagtgacttagagttctataaagaggtgctatgatgccatcaaacataatcatattggacagaaacaatcttcaatagaacttaaatcatgtgccatttaatactgttgctggacagctgataaaactaccttctgacaaagtttgatttaattagactctaataaaaggtcctatgagactttctaaaagactatattgggaagaaagaaacctcagaaaagtctaaattatcaagtagtaccatttaaatactcttactggacagctaataagctaccttcagacaaagattgaatgattaaattgaactccatacagaactgctaaggtgtcttcaaaaaggacttgagaagatgaaagcatctttagaagggccacttaaattcacttgcttgatagaaataaagcctcaagcaagttgttataacttcaggattcgacttcactgactctaagagtatagacatccataatttgaactaatgaatagtccacttctgttcattgcttctctgtcacccccatttgccactaccataatgagtgatagatacatcttcatcacctctggaaatcatctcaggatctaaatggaaactgtataaagcctatcatttttactgatttaaactatgtaaactcattattctttttatgtaatgtgctgttgttattgtttacctgcataaaaatatttatgagggttttcaacagtttacttgagacctcatttttgcccatttttttccttcccgatatcatgatctcctcagctgaactttcttaccttgggggttgttcaggaactgactctcatggggaaagagggattactatttctgtgttcctatctcttggtaactgcttaaccacagtcagtcttgaactaatggaaggagcactggacttgggttcttgagacctgggttcatgttcagttctgccactgattattgtgacattgggccagtcacttgatttctctgagcctcagtttcatcacctgttaagtgaggatagtaatacctggcacaaatatcacaatattagtgataattgaatataattataagtacccaatggctattaaaagtaaaactaggaagtgctgaataaccataatatcattatatttgtagcattttggaccttatcaatgaacaactgagaaaactaggtttttgaattcttttactttttaaagtaacttcctcccatttttatgtcaattatagaaaattttaaaaagaaaattaaatgtgcctataattttataagccggaggtaactaagttggtatttttcttcttagtacctctttgtctcatcataaattgttcatcaatgtcaaaaacttggaaaataaagataagcatatagaaaaaaataaaaaccacccataatcacaaatcccagaagcaatgttaatattttggtggatttatttccagtctttttctatggctatatgtgcacatatataatttttacatagaaaaagtcataatgcatacagctttgttgcttttagcatttttatcatgaatattttcctacatttatgcaaagtatttgtaaatatcattttcaatggtgtataatatttcatcataggatgacatcatggtttagttaaccattttcttttgttggatatttgagggtctttccaaatttggccattgtaatttcacaatgtctttttcattacctaactgaaaatatttgctttggtgaaagcagaggattttttgttgtttgtttgtttgtttttgaagaagtccttttaatagctacatttcattgactaagtggaacttcaagagacaggtagaagaaaaaaaaaaagaaacagtagatgtaatttcaagattgaggatttattttgttagtgactgttccagaagctgaattttggtgttagagcaattcaggagggacagtttgccaccattttatgatactttactgtagaaaagttttcaggatttagaccaggaaagagacatcctaaccatatgggttgattttattttatggaccctgtgaagtctgggactgatcaggtttctcttttgttggctactagaaagcttggagtcaaatgtgtggtcaatgcatagcacttgtaatgggactctacggtatgtatgcactttgtattagctttctgccaggctccatttcgtgttcctatctttattgtttttgttttttccttttactttcttatctactttgaatttatgctatcatgttgtattttgtgtattcttgtaagccacctgacatccatcttggaacatggtggggaataaacacactaataaataaatacattaataaatacatgaataaataaaccaataaggaaaaaacaatgaggcaaatgaatgcagccaggactctgaaaattgcatagtgcctccaagaataatcaatgttaaggacttgaagcttggaagaacatattggaaagaagcaggtgaggctgcgaggctgcatttagaggtgacgtgttctgtgtgacgtctgtgtctactgaagcatgcttatatgtcttgtgtcttctgctgcacttgagcattaggtgtgtttcagaggatatgcagtgctgtgtaatggactgtgtctttagagggcacagttcatgtgcattttatttgtggggaatctagagagatttgggagttggtgagcctgggaatgatgtgatgatcctttttcatggaggcataggaaggaatcattgtatataaatcaaatcaagacaaataggaagtttcctaccatttactaactagttactgggtgccaagctatgtgccaggcactttacatgtattgatttaacacttaacagccactctatattattccctttttacagatgaggcaatttaagctcaaagcatttaagtagacaaccaacctagaatcacatagcaaatgacagaagccagaggcctcccaagtctctctaactccaaaccctatgcttactctactatatcacactaccttgcaataggacaaagggaatatgtggtaaactatgttcccagcatctaaaagccaggagtggttttcatttttctttaagaagatgatagtgtgatttgaaacatatctgaatttcagaagaggggacttttaaaaattgccactcataaggaaagaaagaactttttcacatatttttgaaagaaacgatggtgagaagatattcttgataatagagatatgctaacatttgctttgggtgttttgtaggttagatttttttggtgtgtactttataggcttgcatattgcttactttaaacagctgaagttctaagtaagagtgttcatatatgtgaaagagttcttaaagtactatatagttttgttattgtattgaatatatattgttctaattcctagagtatgtcatcttctatatactctatacagcaggaatccttgctgtacaacaattatattaaagaaaactctcagttatcctttatggtcttgtcaatcaaatgttttggtcaatgcatattactaactttcatctaattaatgcacaataaaatatacttagtgtgataacagtatgcagtctttctttggtgatactggagaccctttggatcttgcagtagctcaaagttattatcactgcaccaataatgtgtaagagtgtcaattaattcagggttctgttatcagaaagccaggtatcagagactgctacatcctgaatggtgcttacattcttggttctgcaaatgtagcccatccagcttagcaaagagtgttctttggaaatcactgccctgcccttttggaaacctgaaggacatggcatcttgcttgtcctctagggtcagtgctatgccccaatagaagagtctcttgtactactcctttactcctaggaaacccgtgttgaaatgggaagaaggtggaataaggacacactctccctatctaccagggtctgtgcttccactttaaggccaatgaatggggaaactgggcacaaatatggtagccccgtaaaaccaacagacagtcaaatgcaagagaagtatggaatgtagggttgggagatgtttacactaaggtaaagaagccacagggagaaataaactgagaggaagtaatgactgaaagggagattaggaggtggagaagatacagaggatggatggaataagaggggaagacagaagagtgctgtatcaaacacgcagtttgatatgctttaaaaaatggagtgttgcaagaagaggaaaattgacaaaggctaagggatatgaagttgctttccccattaaggcaaatgaggcctcctttttctcctcagacttttaccctatataattatccacatgatcagaagtgtctagttaggacattgcctcatctttgctttttgttttcaaatgtttcccatcaaagttgttgcatatgtcaattgaatgcaaatgaaagtggaaccagtatgtgttgcctagagggagatgagtaagaggtaacttcctaatgatttcccagaataatcactgttgctgaatgtttttgaagatgataccactgaaggtgctagctgtttgcatgtgtgagtgggggtgacttgaagggctcacatgtgactatcattttacttcccccatcccatcatcctcacggaacatctgacctgtgaattgggcttgtggtcactcttgcagaatcaggtaccacattgagttttatctgtacattaaagcctgctaatttgtggaggacatatgttgttttccatagccactgaagacctagcaggagaaactgggcttaatattccaccagagagaatggaactagacataaattccagataggctaattggatgctataggttactaagagtgacattttctagaatcttcattagatatctcatggctttagcaagttctacatgaaggcaggagaatggaccttccaccatgggccttcccaactatatgcttttgagatttgctaatataataaaagatattataataagagcagtgaatgtttaagatggcccagtttaatcctcttttctcagtagttatacttctaaggatatcactcataagatgaaagtgctaggtctaaacatagtcaccctgttacttagtatattgccataagatgatgtattttggaaagccgttataggtgtattacaatgttcaaaacctctcatatcagttaccttcttcaaacttcctatgatggaggtaaggcagggattattcccattttacagaggaaggcagaagttcagagaggttaaatgacttccacaaatttgctccactacttaataacaaagcaaggcagacctagaatttggatcccccaactcctagtccagtggtagttgaagactatactgcttacataaaatgagagtagcttgttttgtaaacaggtttcagccaatggaatatgcaaaaatggaatttttacagaagcaagtagaacccaggtgcctcagtggttacaacagtagtcatacctttatcctgacaagtttttcctcctgagggcctaatttgctaataggaagtaactagcttttgtaaaaaagaaaaatatggaatattaaaatagaacacaggagtggtgcacctatcatccctccccttagattcattcatgatccagaatgtaaaagatatttgggccgtcttactcatttaatgaacaccttccttttctgctcagaatcaatatgtattcgcccaagatgctaagtttatgccagaaatatgtatgttatgtggaatttcttttaaaattcttattcagcgtgtactgtcagttgctttaaatacttactgccaacaataaaatctatttttatgcctatctttctattgtagtcaccacatatactttcacatatttccaatgcaaaaaaaaaaataaatttgtaggcccacacaatgatagtctttataccaaaaaaaattttaggtgtaaacaaaagaactgatctctccctgtgtacagggaaatgtacttcttgtaaatccaggagttaagaaattcctgtgggttccctcttgtaatatgcccccaaacaggatgtttgtttacagagcagatgtctcagggattagaacatgctttgcagaaatcagtccctctggaactattgctctcacaaatgagtgcctgcctctttgaaacctgcagggctgctgttgtcataggaagaactattctgagacacttactgttacctaagtataaggaaggcttcagaaggcttccctaaggagggttatggcacagtgtgctctgtgacccacaaatcagaggatgaagcaaaatggcatttttttttaataaaaaaaggaaaaaccacagtacttaattcactttcctggtagctaagtagacagtaaggcatttcatttcttacaggccaaaggcaacattttgtaaatgacttgtttggggcactaactgacagccttttagtaacagataaatcaatggaccaccgaaagcatctatcatccagctaaagagtaacgaagtcactaaggatcatttgttagggaaatgaagaatgtcacccataggaggtggatggccctttaataagacttatatatcctttcaacatggatttcccaaatcaaggctcaggaatattgagatgaaaaataggcctttaaatatgacagatctctaacctagccatctccactgtttctgccagaagtggtccctgtgactacaaaagttgcttggctttaggaatatataacactgaatgaatacagattgcacctgggcagggtgagggggacaaagggtggaaagaaggacaagggcttctggtgtcaagctagggattatgagataagtgcacctcccaggagggcctcgaccccagcaactacactacaagcctcctaacggaatgttttattaggcttcctttatctcaaaggacttaatggaagaccacaggatagagacatatgggtatccagccaatgcacaaatctgggctgcattctgactttgagcacagatttaatttattagctatctcagtttaaaagttagatataacagaatctggagcatgtttttaactgcttatataccactcagaaaagagttgtgcctactttttatgtgcctagctctgtgctgattattgtgagggatactacatatgagacaaggttccctatcctcaggtaattttcaacatagttgcagaaatcatacacacacacacacgccgagtttgtgggaaatgtccagtaagtgatcttagagaaaacagatacagtggtggggaggtcctccccattccactcccaccattcattcttcttttccacctgagtgaaacagcaaccatctggaagcctgcccccaccatggcatgtgtacctttagcagcacacagctatctagcttgtcttctcacacctttttttgttgtgtcattcaactattcaaaaacctttctcagcatattttgtattactacctccgatttcatctttcttcccttcctgatttccaaggctacaccctacttatttattgtgtcttctcatttcctcatcaacatgcaatatgcatccctacttccaaccttttacctctactgttcttcctcgttgagatgacttacccttgcatctaggtatccagtctttaaggcccatttctcaaaacatacctcctccagtaagccctgactgtccaccacagatttctgtgatcttttcttttgacatgctactatcctatattctgcccaacttagcacctaattttctttggtagtttctgttgctatttcttgtttattaaggttatttccccagttagatttcaagttcagaatattactgaagtttctaatgaatcacccagaataacctgtcactacagtgatccacaattcaatatagttgctaactgactcactgattcaaaggaaaggaagctgggacagtagcaggaggaagttgtgttttagagccaaggttgtaaaatgcttgcctcatagaactagtcaaactatgtgtttatttttctttagaaaaattatttctgcagtaaaaatgctttatatgatattttgcttttagctttctgtattaacaaggcttcaaatgttgcttttaaaattatgacatgtaccataatattttgcatgcttttcattgcttttaaaaagatgattattgttttgtgcttttaggctaaatttatgtaggaaagcatttccctatgtctgtcttctgccatcctttttcttttcctgcatgctctgttttcaagaagctagaaagagttctaaaaaataaatctgaaaatgaccatatgacatccagtgaataggcccaacaaaacttccaggaattttaggggaagataacaaatggaactcctacaacaaggaagactcaggtgagagctttctaaattgctttcagaaggcagccatagcaccatccagggatttcatcttgggggagaattggttgctttgctcaaccttgaaccatgcccagctatgttaccatatatgcctttggccccaaagtggtacctggcaagaggtgtgcctgaatgaatagagtcatccccactgttgggggaaaaacagcaacaatgccaccaaaaacaacttcaactacaaaaacaactgtaaaatatactcctcacccttaggccttcttggcagacatcgatcatcttctcctcttctatgaacacataacagcaaataggcatgacctgtccccatatactgggccttatttcatataatgaaggtcattcattcatccattcattttttgttcatttgctttttcattaaacattgagtcagatgctgtgctagataggtgctggggtacaaaggtgaaaaagtcccagtccctggccttaaagaactgaagctctagtcagggacacagataagttattcaatgattagagtttagtgtgataagtgtaatatgtaggagtgagaactgaggagaggcaattattcaagactgaaggaaggggtggttagggaaggcttcctggaggagaggattattgaactgaggtgagtcttaaaggaggcatagaactagccattaaggagtgagtggcatgccaggtagaaagaccatcattttgaaggcagcaggcatgacacgctcttagttgagcttctatgaatacaactacaagtagttcagaaaaactggtgctctgagagtgggagaggggtagagaagaagctgtggatgtaagtggggaccagatcctggagggcttatctatgccatgctaagggctttaaatttgattctgaaggcaatgggggaatattgaagcagggcaatgatatcagatttgtgtttcaaaatatcactctagccacaggaggaatcgggaagagggggaaagagaccagtcaggttgttggagtcatacaggtgagaaatgagagtggcctggcttaagggccactaatagcaataaaagaggacaatgcagagggactatttagggaggagaattcatagaactaggcaactaatcagatggtgagaggaagagctggagaaggttgagttaggaaacaaaagaagagttgttatttcctgtttttgatagagaaaagcacttaattagttagataattaatgaaataattaggcttgattttgaaaatatttagtgtgggggtctgtgaggcacctaaatagaggtgttcaatagccagttaactacatggggttggggtgcaacagagatgtcatggccggaggtatatatggagaatcactagtgtcagtggggattgaaatcatgcatgtggatgagatgacccaagggagaagtgtgttgatgagaagggatgaagagccttctgcaaatgaggctgagaaagaaaactgagaaatgcagaaatagactctaagaaagagttgtatgaaagaaggtgggggaaatgttagcttcaagaagttcgtggtctcaaatgtcagttttgactgagaggtccacacttgtaaggacagaaaagtagccattggtcaaggaggaggctaatttgtgacttcaggggagtcattacactggtttgaggagtgagagctaaggaaatctagattaccttttcaagaagtttaacctaaagaaagaaaagctaagactataacagctagagaagtatgtgaagaagcagaagcattttaatttttaaggacaatagtgatctcagcatgttttttaagccaaaagagaagtgccagtagagagggagagattgaggatacaagaagaaatagagcataattggtggattcactttaggtagaaggtggcaggagtgagacaggagaagagaagaagatgctactgctggagataaattcataggggcgggagagaaagtgaaatcaaaggaataactgaaaaaaaaggagtccctccatttatctcagtgaagtagaaggaaggtcatatgctgaaagtaagggaggagggggtagagctgaagttagagtggagttctgaatttctggaatattgggtgtggtgattggaaaaggaagttggcaaggggtgacgaaactattgtcaagcaccattaatgacccagctatcataagcaccaaccaatctgcatggctgtgtgatttccctccagcaactcttggcagccttgacatagaagtggagagctttcatggttggattctattagggtagggtttcataggacaattataacaagaagtcaaagagtgaaattttccaggacagaagcataagagcaatttacatgctggacgatagagtctcagccagaaggaagctgagaaattggctaaaaatggcagtgactagaatgatattttgaaactcaaatctgctattattgccttgtttcaatattccccattaccttctagaaatggaggtcttgttgagatcaaagaacaagtaaaataggagtaagcacttgaaacaattagcaggttagccagatgggaagctgagctcagagaatgagataacaaggttgaatattgcagagaaagggttattctggataataaaaagatctggggcaactatggttcttcactctggctgtgcattatctctggagttttaaaaattcatttgcccaggtttcatccccagaaatcctgatatagtaggttattggtgggctctagatattggtattttatggaactctacaggttattctgatgtgcagccctgcttgagaaccaatggtttaaaagatggctgtgggaatgattgcagaagtggaagggaggtaaaattcattagagttgagagagatcaaggatccataaggaaagggtatgaaggaggtgtccattaataccctgtttcacacagtggtggcagcacagaatgtaggaaggaagactgggagccaaagtactcaatggagaacaacgcacttggccaggagaactaggtggtgataatctcaaaagagaggattttgtaggcaagtgtagaagtactgatctcaaatcatttggagtaaaaaaagagaaagtctgccttctccattctctcaggactacaggcttgggatgagaaagggtgagcagcctccaccagtcttatctaaggaagcggtaccctcactggatagtagagtctaaagtcattgttctcagtcccagctaagtaatataaatacctgaggagttttaaaaaataaagatgcctaaggctaccccagactaactgaatctgaatctctggagatggcatctctctttttttttaagttctcagatgaaaatgatgtacagtgaagtatgaaaacctaaggcaagaggtgaaggaagaggtagaaaatgtagaaaaaaaatgtttctgataggacaaactcttgcaggtaaaagaactgcagaacattggggtgggcatataaaaggtgatagatgactagagggacttctcattctttatgaagtagtagaatagagaaagatgtcaggatgagagattctggagagattagctagccccaggaattacaaccagaactcccaatagatctcaaggccaaatgctgtttgcagtttgtggtccaggcagcaatttgtagccttgttctgagttccaatagaatatgggaggtacacttagaaagtgatacttttttggacttctgctctctgcaaatatcaacccagatagctgaccaggttgagctttaagataaatgacaaatgctcacagaattttgcagggtgatacagacattttagtgtatctaaaaaacaaaacaaaagaaaaactggttttcatctagggtctagtttattgctaaacacttactgaaagctagagctcaaatcttttttttttttttaatgccactgagtaataaatagtttaactgttgaaaactttggttctggagacaaagtggggacgtagattcaaatcctggctctgatatttgccagctgtgtaaccctgggtatatgatttaaccccaatgagtcccacttatctataaaacaagaacaagacctgcctcatatgactgttgcggagattaaatgagatagccccagatacttggcacgtggtgagtgtcccattcgtgatagctattaagtctgcaggtacaagctagttgctggggaatgtgagaataaataaattacactctttactgtcaagtatctcaaattttagatagagaggtagatatgtaaaaaataccaatcctatgctgatggtaccaagctcaaagtagacactgagtagttctatgggagcatgaaaggacaggcatttaactttgtctgcagaggggagataggaaaagacttgccaaaagtgaaaaagcccaagagtgagtctttaagagtaaggactaataggagtgatccccataaatttgggggagagggtaagaagtaagactttccaggcataggtatagcatgtataaaagcttggaggtatgagaaagcctggcagtttagggagcattgaatgtgtataagtagtggggcacatggcaagaatagagaggttggagtggtaaacttaggaacatatcatgcaggcccttggatatcatgctaagaaacatgaacttttaacttatgggtaataggggacagcatttaagcatcttaaagtcaagaatgttattcaggaggctgaggcaggagaatcgcttgaacccgggaggcggagtttgtagtaagcagagatcacgccactgtactccagcctgggtgacagagcgagactccaccaaacaaacaaacaaacaaacaacaacacacacacacacacacacaaatgcaagaatgtgatctagccacagagtagagaaatgaatggaagtggataaaattggaggcagtgatgctaagtgagaagtgatgaagccttggactaagttagttatttgtggggatgaagagaagaggatggattcaagaccagtttaggagatagaatatacaaaacttgatgatgaattagcatagaaataaaggagtgaaagatgactcccagattcttggtttgggcagctgggccagtgctggattactcaggagccagaacaagcatttgtatatggcatctagtaaatctgaagtacccaaaatgtggaaacagtttaattttgaatatatagcttaaaaaaaagactcaatcaccataggaacatcagaaattttgcacttccttaattgtttatgccttagtattgtttttatttgaattgcatattggagaggaggatcataattttttttcattgcttagagccgcctaaaggaggaggagcctaaggccttgcttcttctctaatctgcgtggttagtggtatcatttcactgtgatagagaacaccagaagaggagcaaacttgggcttcctgcctttgttatgcttagccctgagtgaagaaaattgcatagttaggctgataaggcattggcagtctggtggccttctaggaaaacaccattaatccaattctgcatgtaactcagcccaagtggagtgttgagtcaatttgctacaaatattttgccaatactaatagaaaagttgggagagtttatttgctgacaagaggggccatgaattcaaattgatataagatttggaggtacagattaaggtaggggctcttaactcagagtccaggagaattatgaacctgtgaaagtatatgtatatagtacatttttatgggcagaagttccatagctttcttcagatttttcagaagattgaccccaaaaagcttaccaagagctaattactgtgaagtgaatgaaactgctccttcagagttactcacttgcctggaacccttccagggccctggaggggccccggtacatttgtatttgtaattttataatgtcttttacttaaagggaaccttcctctcaaattacatgaagtatttggtcccccaacatgtggatccacccctgccaaccacagattagggaattacctaacatgagttagtatttgggagtggaggcaatccaatagagaaagaaatgtagaaggccaaaaactgtactagcaaaggcaaaagcaatgacaatcaaagaaagaaaggtcactgagaaaggaggaatgccaggccacattgtcaaggaagtagaaagagaagtagctagccatggccagcatgggtgggacatcatgaaagagaaaaagtaagaaaatgattacaggagtggctaggacaccttcaatagagtgatgacaccagagtgcctttctgaacaagtaaaaaatggtagttgaacaagtataaatgttagctatagttcacaaacattcaggggaagtagaagtaccaacagaaaactctaaacttcactgttaggataatattcatgaataaagtaggctcactgtaaaaatggaatctgtaatgagggtaagttatatggcatatatgtattttttcaaaatgaatcctaaatgtgctccatggccagacaaaggccttgggtgactcttgttcccctgctcccaacctttctttcctgatcctgtatagttcctctcactacttcagttttcttatttctgccccatatctctgtcctgtggctggagataaggaacagtgagagagagtggaatgagacaagaagccataagaatagcctttgaacatgaaaagttttgaatttaaaatttatcatgggtaacccacaaaaccaataatccatatacggttgaatgttgtctgtaattcaggccaaggcaacatctatttgaaccagaatgttctaaattgaccgccctggcaattctgaagttgattggtcttaactgggtaaacctggttcatgctgacttgccctgtattaggagggtgagtactatttttttcagtgtgaaatgcagcctcaccagagatacatgctcagatctgctaataagtgtgttatggaagcgactagatgccattttagagtgtttccacagtgacttcctcctgggaactatttccagatagactatagttctcaacttagtttattcagtgattatatctttataggcttttaaattatgagctactgatacatttatttataattatgtaactatgaaaaatctgctacttgaaaaagacaatgatttttgaatggctgatatgacaaaatataatggaaacatggacaaataactacaaactagaaaaactaaaccaaagaatggctttaagttttctgaaaactaaataaaattaattcagtaaaaaaagcagcaatttgtagctttttactagcaaagtgctgggtaggaaatgattgaaatatttttaataataaaaaaggtttgtaacataattgatttgcagtggtattcttgttaatagaagagtctattaagatatggttaataatagaaacatgttaaattaaataagtaccaaccacttgattattagctatcgttaacatagaaacaattcacaatatctttattgaaagctgaagtgcttttctattctttctaatagtatgccttagcttgacttgtatatgatgaatttcttccttagtaagtgatatttgattcaacaaagccagttaaacacaatatccctagatatctcctggttacactggtaaaaggcataaatcagtttgaatgagagatttgtttcaaatgagttttggaaattttgaattatttggatatgacatttgtcatcaccctcttagctacttctgcaaataattggaatttctggagttaagtgttgttaaaattgtgttggaatcaattgtctttcaactttgtaattgttttgatgaacctaattgtacaacttgtggatgccaaaactataccccaaataaatacatgttaacattttgcctttagccaataagaagaaggagaaagagcgcccagagatctctcttccttcagactttgagcatacgattcatgtggggtttgatgcagtcaccggggaattcactgtaagtaagctccttgttttgttttgtaagccacgaaagaattcctttgtgaaaatagttttcaagcaagaattgccatgtcccaaaatgtcagacttaatatttttgatggttccaaataagatggacattgcctaggcaatcatagatggaaatagaggatggcaacagcattgaccaaattattttgtccatcttttaaaaaagtttgatcactgtatagtctcaacttggttgaaaatattaactaaccatggcacagaagatgtactcctggcagacagatactgcctgagctttttctttatcaagtgaatggaatcagagaatcatctactcaccttggccagtgaaaataattcatctgaataattcaggctttacattaaaacctagaatacccagatcagctaactacgctaaccaagaatctctatggaactgacctgtttttccctttgatttctagaacatagataagttttacaatttttagtaggtatattttgtagattttcaaaaaacaaaccttatatttcaagaagaaatattgatggatatatcatgtatgttctagttgttttgggcatctctctcctctctctctagatatctctctctagagatgtcatgcaatccatagtacataccaataagaattcgctggacagaccatagctatagatcaagccttttgctgaatatttgtagtgctcaaatagcacaagatctcagatctatggaattttatacttttcttttttaaaaaaaaagaactggtatcttttttattttattttattttagctcaaggagagaaaagatgtggctattgctagaaatatgtccccaggaaggtcaactaccttttcccatactattagtgaactccatcaaaatgtacattctgaaataaggagtaattttgagggcatttcaaaaaaaatctttgatagagccatcaccatcaattcttgggctgttaaaccagagagaaatttacatattaagtagttgagttttttgtttcataacatagtagtgaatagactgtgttatatgattaagcggaaaaaaagaaggaacaaattaatctatgtggagaagcaaacaatgttgctgaattgacagtcaaattatcttatttcttcaattctggaagtaagtgataggagaatggaaatggaaacagtaaacaccttggcctcataaagtggtgtaagctgattatttctgcgttctcagtagcaagcagaggagaacgttaagaaatattgacacataaagtggagataggtaagatttaaccaatttcatcattaaagtcagagacattactcaaatggctttgagtgtgaacccattctttactatatttgcagaatattctcttagccacacttagatactccaaccttgctattatgactaccaccaccatcatcaccaccagaaaaaaacgtaatttgtataacctgaaaaacgttctatttttaaaaaattacaaaaagattgtaactatttttgctgacacttgaaacaagaagatcccttaaactttataaaaattttgcctaataactcttcccttttttattaatttttccagctttgacattttaatgttctctgtgcttttcctcatttaaactactattgtgttttattgttgtcattcactatttttcttttcttttttcttcctttttgttttctgatgtgaaaattttctcatccagttatctcatgtgatattctagttgctctccaatattttattctttccacttttcaaacttacttgtcatcttatgatacagtatatctctagctctttcatttatcattctggattctgaatggaaatgaaagaaagtaaatcaccaccatcttgctgactgcagcaccagtcattttcaatttgctgtcaattagaacccaaagaacccaaagtgatggactatctttccaatgatgaaaaacagttggatacaaccaaaccatatgaaacaaatactcctctccctactaaaaatatccccaatttgaaataagatagctgttcggaagtattccattgttacgaatccattgaatatatagaaagacataggctaaatttggaaaatggaagtactttattgtcatcctgatgatcttttgtaactacttgttcatacattattcttaaagatgccaaattctgccctttttggtacttttttaacctgtgatttacatttactatattattatgtttattaaatgtaaacatgccaaattataaaaagcttttaagaaagtctttttattggtaggatttagaattgggtcctaattgtcatagcaccactaatttattgtgtgttgggaggggatcatattaagtttgattatcgtggttgttgaggttgaattttgtgcaatttgctgaactatctaatccagttgtcttacaagggcttgttattttgaatatttggacactgatttgctgtgttgcttggtgattactctttggctaattggcccatatgaccttgtatacctggtcatacacttggaccctgaagctaaaagtaggttgggaggtgagatttttggtattcaatgattataagtcctcatcctttatattgccatttttgtcccaaatacttcagaactcccctttccagacctctagacctgtgacggtcgcttcaagtcaatcagagggaaaaatggtatgagtgatataaattatcatttcttatgataagataaatgcttggcctgttatatcgtgctgccattctcctgggctacactggacaacccccagcttaatttacttctagttggtatcctatacacagtcagacattgatatgtgctcctgcttctgatgctcaaactcctaggtcttcattagctgtctaacttttgggattagttcctcaacgtggcataatgagatggctttatgactatgtgcctttgtggcatacattcaaatttgaatgtcgggttttagtgataattggatttgtctcaacttagaaaaaagaaatgtcagcagtgtagtcaaaattatgtcagcagtgtagtcatgtggtaagtatagttgtctggaggattttctgctattggcagcattttttcctgctgtctagtgatcataaaactatttatcacaaaagtttagaagtgccatgggaatgtataataactgccaatattctaatgattatggtaatgattatgccagtaatgtctgctctagtggttatgtgcaatgcatacctcaatttgtaacacttaataactcctttggccattacggtattaacaaatgctattaattgcacttagaatcataactgggatcatgcatgggctcctgagttcaaatttttggcttaaggctttagcatctagctgcgtgaaaaatgcatgtaaaagtgtcgtttcactgtgcttggagtaaccctaaataccaggaatcaaggacatatatacaaaatcaagccagttgggtcaagcatgtttctgtagcatttgagatatctttatttaggcaaagctgttaccttatatcttgtcttattttgtgggaagtgggattttagaactgcagcactaaaatggaaattatatatatatggtttgaaatggaattgttcccctttccctggtctaaatatctaagaaacttaacatatagagtctggctatgtgggaatgttctttatctagttttctctaagccagccatgactttagctacaaagtgcaaaagaatcacatcaatgagaataaaattcaatgtttccatacagccatcctttgaattttagccacatacacacttttgaaactaaaattggttaaccagaattgggaactgaaatttgtaagtttatcacatggccattggctacctgtgatcacccagttataaaaacaacttacaaattattgtcaaagcttttcatgatgccatccttcttgcctccaaattcatgtttctgccttttaataatttctccaatcatttaatggtaattcttattaatacatatttatggaggaagcatcttgccaaaagtggaattatacatccaaactttgaagcatcgtcgttctctctgttctcttaaatctgttgtcctgtagcctgtcctgtccctgatttagttaaaacctccctattttcataactgccccactttagaagggactccccccattcagacccattggtttcatctcctcccaccttctaagttgtcccacattctgttttaactttcttttctttctttatttacgtccattacagccagatctctatggctcacagatgtgcccagggaagctcccagaggtgcgtcacaggcccaaaagaagcttgcatcaaagtgcttctttgagatgtcatagcactgcagcagcaggttcatgtgtgtgcagtagagttgttgcttggcttatctcactttttttgttgtcattcccaaactctggaggcccacgtcacacattgttttgccgagacttcataggataaagccacataaattgtgtctggatgcacttcaggaatagtgtgtctgtttctctctccaagttgctcttggaggttggataattatgaaattgggacttctgtaggctggacatgtaggaaagaatgttgaatgctcaatgcaaagctaacctctaatttttgcaattctccttggttagatttccaaatattccctcctctctgctctaaatgcttcagattattataaattatcacaaggctttgtcgtggttttcatagtccccaggttctatgtggcctataaatgaagtaaggaggaagggagagagagaggagaggagaaggagggcatgccctggagaaagctgcaggggaaatgcccaaagcagcattaatgttactgtttagcatctcagtggttcttgcccctccacaattctatttttgtctcctaccaacctgcctttatagtaaagcgctagacccaaaaaattacattttgtaatcacaaagtataacctgaccaagggtgatcctttccttttattctaaaatatattctgattacaacatgaccagaaacagcttgttattccagtcataaaatccattgatctgcactttactatgctgtgcacaaatttagagaagtcttgctatgtctgccctgagtcgccagaaaaaaaataagctaagccgtaaacatcatttcatggatgagcagagtcaatatggaggtgattttcatgcgcttttttttttctatcacagtcatactcccacccaccctttttaagttggatcctagttttacctatgtgttttaattagagaagagaatgattgcattattaagttactaactttaaatctagaatgtaacttcagtttcccaagtgtaatcctacaggtagcatgggcttcttggtgaagaactttactggaacataaaaatgctgctgcagaatgttctgagctaccattctttccctttggttgtccacagggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggaggtaagaggaagtctgtggtatcaaaggtgaaaaagtaatttcaatttcagagtgtcatgttgagaacaaaatgtctgtgggacatttgaaatcgattctagtaccttcttcaaatgacatcaacataaggaaaccaaaaaatgagttggaatttgaggttgatgttaagttatataactcaagtatgtttagaatcaaaataaggtaattatttagtgaaggagtagttgtgagcttgaactggtagtcacaattgttgtctctttactgtcataaagacactcagtcacttactgggctttgttatatgttcatgaagtaagagttgtatgtatgaaaccatgctctctggaaatttactttgtcccttagattcattgatttacaccatgatgacacagcacactgtttttttggtgtcaggttattttgctaagacccccaaatcagactgaaaagagaaaactatgtgtgactatttttagaaactgaaatatccatgttactgccaaatcttgaccttatttgctagtgtgtagatttagtcttttcttggagctttgatgttcaaatttgcactataagcaactgtattagtccattttcatgctgctggtaaagacatgtccaagactgggaagaaaaagaggtttaattggacttacggttccacatggctggtgagacctcagaatcatggtgggaagtgaaaagcacttcttacatgacagcagcaagataatatgtgaaggaaaaaagtggagaaccccgataaaaccatcagatctcatgagacttgttcattatcatgagaatagcatgggaaagaccagcccccatgattcaattacccacccccgggtccctcccacaacatgttggaattatgggatatacaattcaagttgatatttgggtggggacacagccaaaccatgtcattctgccccggcccctccaaatctcatgccctcacatttcagaaccaatcatgccttcccaacagtcccccaaagtcttaactcatttcagcagtaactcaaaagtccacagtccaaagtctcatcttagacaaagcaagtcccttttgcctacgagcctgtaaaatcaaaagtaagctagttacttcctagatacaatagaggtacaggcatttgttgaatacagccattccaaatgggagaaattggccaaaacaaagggattacagggcccatgcaagtccaaaatccagcagggcagtcaaatcttaaagctccaaaatgatctcctttgactccaggtctcacatctaggtcacgctgatgtaagaggtgggttcccatggtcttgggcagctctaccctgtgactttgcagggtccagcctccctcccggctgctttcacaggctgctgttgagtgtctgcggcttttccatgtgcaaagtgcaagctgtaagtggatctaccattctgggatctggaggacggtggccctcttctcacagctccactaggcagtgccctagtagggactctgtgtgtgggctctgagcccacatttcccttctgcactgccctagcagaggttctccatgagggccccacccctgcagcaagcttttgcctgagcatccaggcatttccatacatcttctgaaatctaggtgtatgttcccaaacctcaattcttgacttccgtgcacatgcaggctcaacaccacgtggaagctgccaaggcttggggattccaccctctgaagtcacagcccaagctgtatgttggcccctttcagataaagctggattagctgggacacagggcaccaagcccctaagctgcacacagcacggggaccctggagctggcccaaaaaaccagtttttcctcctgggcctatgggcctgtgatgggaggggctgctgtgaagttctctgacatggcctggagacatttcccccatggtcttggggattaatattaggctccttgccacttatgcaaatttctgcagccagcttgaatttctcccaagaaaatgagtttttattttctatcgcatagtcaggctgcacattttccaaacttttatgctctgtttcccttataaaactgaatgcctttaacagcactcaagttacttcttgaatgctttgctgcatagaaatttcttctaccagataccctaaaacatctctctcaagttcaaagttctacacatctttagggcaggggcaaaatgctgctagtgtctttgctaaaacataacaagagtcacctttgctccagttcccaaaagttcctcatcctccatctgagactacctcagcctgaattttattgtccatattgctatcagcattttggacaaagtcattcaacaagcctctatgaagttccaaacttccccacatttttctatcttcttctgtgtcctttcaaactgttccaattgcctgttgcccagttacaaagtctcttccacattattgggtatctttttagcaacaccccactctactggtaccaatttactgtattagtccgttttcatgctactgataatgacatacctaagactgggaataaaaagaggtttaattggacttatagttccacatggctggggaggcctcagaatcatggtgggaggcaaaaggcatttcttacatcgcagcagcaacagaaaatgagaaagaatcaaaagcaaaaacccatgataaacccatcagatcttgtgagacttatccactatcacgagaatagcatgggaaagaccggccactataattcaattacctcccactgggtccctcccacagcacgtgggaattctgggagatataattcaagttgagatttgggtggggacacaggcaaaccatatctgcaactgaaatatatataccaaataatactttcacattttgagatagatgatttgagttctctctctacaataatttattaacttattaacatctaaagaatgaagggagtattatcattagtactacagctataaagagcccttacctcttcgcactggatttagtataagcaggctttaagtttctttgagaatgatccaaggatacccttggaaagggaagagtgtctgatttggccatatcaaatatcaaagcccaaactgctaaattggactattgcttaactgctgttatccaatgttgaaaacctaaaaagaaagccatcaagggaaactttttactatatttaagcttccacatagaataaaatatctaagagatcctggtgatatatcaaaaaatgtttcatgtgagaaaatcaagagctgtgctccaagttagaaccataggcaaccagaactgaaaatgtattcaagaaatcatttcactgtaaccaagaatacactttagagtatcagagtttgttctttactccaaatagccattgctgtttaacacttagttttatatgccaaatttctctcaacttacaaagatgaaatcctgacaactatattaaaactcaactgtacagttgtactgtactgagctgagtgtacctcatcataggttttctgaatgctctggtattgggactgactaactgaataggaagagaagatgaagatagcacaggaaggtggaaagaaggaatggaaaggaggtagggagagaagaaagtgggaaaaatcctagatttagagtagttctccacttatccatgtggaatatattctaagatctccaatggatgcctggaaccatggatagtactgaaccttatgtatatcatgttttttttctatacctacttacctgtgataaagttataaattaggcacagtaagagataaacaacaataaccaataataaagtagaacaattataacaatatgccagcatcactacttttgctctttggggccattatgaagtaaaataaggggtacatgactacaagcactgtgatagctccgcagttgttctgataaccaaactggctattaagtgactaataggctggtagtgtaaacagagtaggtacactggacaaagggatgattcacatttcaggtggaatggagcaggaccgcgtgagattttatcatactcagaatggcatgcagtttgaaactcatgaattggttatttctgcaatttttgatgtaatatttttgaaccacagttgaccacaggtagctgaaaccacaaaaagtgaaacttcagataggggggactactatagatgtacagaatcatacctgttaagagtaggtaatcttgtcattcttccatataaatgagattcactggaggccttcattaatatctgcaaaatgacctggtgagaatatggtgaggatgtaatggtgtgagctattttaagaaaagctatgtcattagtcataatatctagttaatactaaattggagcatttccttctagttgaaatcatgcagttttttaatttttatttttctggtgtggtctctgaatgaaacattctttatgaaacaaaaatgacctctctattctcactttgcagataaaagtgcacatggatacatagcagcccatccttcggtaagtgaaaaattgaaaactgtttcacatgattggtgtttccaaagatttaagagaatataactgcacagatccagtttttagatataaagtcttttaaaaacaattttaaggtataattcagtttatataaaattcacctattttcaggtaaacagttcaatgagttttggtaaatgtatatacctatgctaccatcaccacaattgagttttagaacaagtccatcaccccagtaaaatccttcatacctacttacagttaactccacccaccccaccctagtcacaggcaagaactaatatggaatctgcctttatggatttggctttctggacatttcatgtaaatgaaataatacagcgtgtgacttttgaggattggcttttttaactcagtttatttattttaagattaatccaagttgttgtgtatatcaataatttgtgttcctttttatctctgagtattccatggtatgattgtaccactgtttgtttaaccattcaaacattgaaggctctctagaaaattttcagttgctagctattacaaattaagctactaggaacattcttgtacagggtttttatgtggacaatgtttctgtttctcttacatgtagaactttgagaataataatcatgttaatagaaatttctctgaacacctacagtgtacacttataatataaactgtaagataattttatttttataggtacttaatctttcctacagcccagttaagtaagtcttaccattgtccccattttacaggtgagaaaactgaggtttggagaaattaaataacttctctaaggttataacagtatacgttttgtatgtcacttgttccaacaaactgagatacagggagggaagtgcctttgtccaaagtcacatagataatttttatcagagaagtgactagaaaataagtaacctagttgttgaaagtgctatagtatctgaaagaatatttgtacacattagacagaaaatgatctcagataaggcttccctttctgtgattttcattttgatattctgatagaaattacttcctgcctcatttgtttttttaggggtgaaataatttgcattactgaaagtctcctaaccatttattcaaacagtcatggatggccaacctgattcttcttccttttatagcagaccaatgccttttatagtggacagatgtctgcttgacatcaccctgggtagccagtatgacaccagtagatcttctttagttgtaaagagtaaaggttctgaaatattatgtcagtttctcaaaaattaaaaatggtattaaccatatgatctagctattccacttctgggtatatacccataattgaatgcagggtctccaagagatatttatacacccacgttcattgcagcaatattcacagtaggcaaatggtggaagcaacccaagtgtccatcaacagatgaaggggtaaacaaaagatggtatgtataaacagtggaatattattaagccttaaaaagaagacaattctgacacgttacaacatggatgaaccaggagaacattatgctaagtgaaataagccagtctcaaaagggtatatactgtatgattccacgtatgtgaggtacctagaggagtcaaattcatagagacagaaagtagaatactagttgccaggagctgggagcagggggagtgggcagttgtttaatgggtacagagtttcagttttacaagatgaaaagagttatggagatgaatggctttgatgattatacaacaatatcctcaacagtactgaaatacatacctaaaaatggttaagatggtaaattttatgttatatatattttgctacaattaaaaataaaatgaaaaaagaaagaatgaaggctctggatgtaggtatttaatctgatttccccatttactaagtatgtgacattgggaaactagcttagcttctctgagcttctttcctcagctttaagagggaataaaaatagtacttacctcctacgtcttgtgtgaatattaaatgtgataatgtacataaagtacttagtatagtacttagcacataatatatatttattaaatgtaaactactattatttttacatgacaacaagaggaaaaactcactctcttcacacatgaagcttgtacttgcgctttgctcagattccccaaaacagaacagaatatggccctctcatctgactggccatttccttttcctccttctttgccatgacagcttcctgggccacactgaaaacaacatgtgaagggaggtaataggaaaatggaaaggacaaaaatgacagccttccatgatcaacacatactttacctcctttgacttcattaatatcatgcttgtgcaatcttgactgggtattctggcaaaaaaaaaatagttattatttttttaggttggtcagttatttgaaacaccaacttgctaggatagcctgtgtattggtttttgttttctcctaagatattaactgtttcttttgagattggttctattggttttgcttgtagaattaaaatgaagtctatgttatggctaaaatattccattaagttagaaaaaaaaatgatgatctcactgtctggagataaaacaaatagatatttacctatttaacatatatttaccaactgcctccttataagctctaggaagtttggatatcaggctggtaggggaaggtaaacatggacataaagaagtacaatacagtatggatagtggctgagtatagtggttcatgcctgtaatcccagcactgtgggaggtctaggtgggcagatcgcttgagcctaggagttcaagagcaaactgggtaacatggtgaaaccctgtctctacaaataatgcaaaaactagctgggcatggtggtgcacacctgcagtcccaactactttggaggctgaggtgggaggatcacttgagccctggaggtggaggctgcagtgaggcgtgattgtgtcactggactccagcctgggtgacagagcaaaaccctgtctcaaaaaaaaaaaaaaacccaacaatatggatagtattacatatcataaaatatgttgacatgctatgagatttcagagaaagtagattgcttttagctggggagggaaagggaagcaggcccttgtctccaagggctgaagctcagtgtctggtaccaaatagatacttggtatgtatttgttgaatgttaagttagaaaatgcttcatataaaagttggcatttgagctagatcttaaaggtcagatgagatttcgatctgtgaagatgggaagggcattttaagtaaaaagaaaagcataagaaagggtgtgttggtgagtagagcaaggaaacaaggaatatggggttgaatgaaaactgagatgcgagaaagggaatcaggaaataagtcttgaaggttaaggcggaaccaaatcatacaggcccctaaatggtactccaaggaatctggctttccagtattcagtgggaagcttttgaagtgttttggagcaggagagttaagtgattaacacttataccttgggaagagtaatctgacggcaaatgtccagaatgaattaagtacaaatggtgagactggatgaagggagactagtagggagaatattgcaagcatccaggtaatctgagccagaaatgaggtagtaacagtaggaatggggagattacattcaatttctagaggtatttagattattaattggatgttggaggaaagggtgaggtcaaagataaacgcaggcttaaactgataggtcgtgggtaaaaagataatgatgctgtctttcaggagaagccaatttctgtgggaagatgctgagttccttattggacagtttgagtttgaagggctggcaggactttcaggtgaaaataatggattgactgcttgatgaaggctaggtttctattgattgaatgaactgaattggaccccgacattctatttgaattacttcagtgggactcagttccttaggaatggataactgcaccttgtgttttccttatagttctagaggagagtatgcttcgcaatgtgtatgtctttttgcatcataaaaactcccagtagatctggctgtctacaaaatctgatttaatgggtctgacaaccccttgtagacatagcctgaattgattacaagttttgcatcctttagtagcctgggtgagaattaaaacagaagcaatgttgcattctctaagtgttttaaactcatgattctgtaattaatattgaactcagggatagatctcatagtcatataacacctgctttactgcttatttgtggtagcttctttgatattagtgtattcaatttcaaatactgttcaagtctctactctttaatttgaggctaattttaaaatttcatatttttatcgtactgttgaaaataaaatgacatatttagaatcctaagttagtattccaactggaaggtaacagcaataatatgtcattattgttttgtcatattgaacgtgccattatctatgcttagagcaactggatgtgcagttgacagattgctcttttgtgatttgcagtactggttaattttttttaaacatagtttaagtaattcttttacttcagtgtgcatcagaatttcatggggattctgttaaattgcagattccagggctccactcccagagtagatctggagtagaaacctaaaatctacattttaaacaatcaccaaaagtggcccccaaacagcattttatattatctaaagcctctaagttccttacttctaagttctttgacctttaaaaattaagctcagagaaaaggaaatttcctaaggtagctactctagctggtgtattctctagagcaacgttcagaacttggagttcatgggtgggcttcagatctatgaactgttgaagttatacataagagcatgtgtctacctgtacctttccggggagatagaccaaaccctaagagtccgggacccaactcaggttaagaacttcattcccgaccaggcgcggtggctcacatctgtaatcccggcactttgggaggctgaggcgggcggatcacctgaggtcaggagttcgagaccagcctgaccaacgtggagaaaccccatctctactaatacaaaattagctgggcgtggtggcacatgcctgtaatcccagctactcgggaggctgaggcaggagaatcgcttgaacccaggaggtggaggttgtggtgaacagagatcgtgccattgcactccagcctgggcaacaatggcgaaactccatctcaaaaaaaaaaaaagaaaagaaaaaaaagaactacattctctgccccaatgtctagcaaaattagagtgtcaaaaatatctaatttgataagacaaaaatattccttacttgttatccatctatctatatttctgtaagtttagaagttttagatacagtaattctcagcctggaatgaagagcatggaaacattgcaccattgactccaaaaatgatcaccaggaaaacctctaagtaaagctatgtttattaaacttagagtgacataaaagcattactttgataaagtctttgtgtcttaagaaggggatgtcaggagggaatatttatagggttttagggcttagactgtttgattttaaagcaggtcttgcaaggcgaggaatgggttaagattatgcagtgtttatgataacatagctttgtattggtgaatatagcaaaggaaggggcttgaagcaagttttagtgagcaagctgttagtctcaatgagcaaactagttggttcacggtatcttctagaaacaagtatttcctaaagtaagaagctatgttatttttgcttattctcactattgtttaatataagaacattaaagtatgtctgtcttgatattgactaacacagggaaaataaaatatgcccagtcccagtactatttacacagtgatagtaaagtacgcctaatcccagtattttttaactcagggacagaaattgttaatttcagttctcagtaccaaagattgctatccttggtggattgctggggatttaatgctctctggcccaaccataattcaaaacatactatccactcaatgccatacattcttccaagtcaaccaaccaatatggcaggatagtgtttggtccaaagtaaacagaaatatctgtctttttcttttcccacaaaccttcagaggacaaaaaccttcaggttttctaatagtcccttaagtctatccttggagatggggaatggtttccactggaagttagcagtgaagatagtaatgaatgttaacagtcagtgaaatcttgcaggtggatcttatctagtgaagtattaagacttgaaatgtgtaaggctgctccttgccccagtaggcagactgatctttgtaccagtttaaggtttgggccaagaagactagaccttgaatcattctttttgcctctagggccgtttttagagcctaatagactgtatatactctcacttgtagaggtcacatcatgcattgctttaaacatattaaagggcccccatacttcactttatatttttgctgtaaatttttgaaattatttttgacatattaattttgaaattatttacttacaagtaacttttaaaatgtatggttaggtataatttcttgttaaatcattgtaaatactcaagaatttttgctaaatatgaaaatcaaacctacaatttatatttaatataatgaaatttctttaaatgctaaacataagagactagttaagttggcatattgttatacttaacagacatttaattaaacattaattaattttgactttatagttttcttgtggctttttggagctgatgatttatttctgatggcaaacactttcacgggcccatgtaaaacttatcaaccctgggcaaggttcgtattgcctaatagataaaatagcaccatttgtcatataaaaaagtactcagcttccatccttctacaaagaaacagtgattaggtacattcttgaacccagctggtgtaagatagggcaaaactttctggaacataatatcaaagcaaatttcgataacccaaagcccatttctccctgtgccccctgaaatgccctgaagaattagtgttttgcaagaagaaagtgattttttaaaaatctggaaacttaatgtcattaacagatgttgctatccacatagctatacaatataatagcccagttgttatggctaaattaagaataaatataggtgcataaataagaaaaccaatattcagtaaacatacaaacttcaatctataaaccacttagcatttatatcagggcaataaaatattctttcaaatgcttgtttataaattctaggttggctttcttctcacaattggtaagtctttctggctcctatcagatgtgtgattacaccttattacttcaccataggtttatacatgattgtagaaaagccacattgaatttttaatcacaattgaggtcctttgatgtaatggtctattaataggctgcctataactgcctcaggagctttgtcctcaaagaatgaaaattcattgtcggattatgttaggacagtatacccagtggcataaacaaaaacaaaataaatacacaaaaacaaaacaaaacaaaacacctataatagcactgtccaacaaatatataaactatagtcataactttaaattttctagtaaccacatattaaaatgtaaaaaataggtgaaataaattttaataatatatttattaagccaatatattcaaattttcagcatttcaacatataatcaatataagaagtattaatctaacattttacaattttttgatattaagtatacaatatctggaatgtaatttacacttgaaacacatctcaattcaggctagccacattttattttattttattttattttattttttattattattatacttgaagttttagggtacatgtgcacaacgtgcaggtttgttacatatgtatacatgtgccatgttggtgtgctgcacccattaactcatcatttagcattaggtatatcacctaatgctatccctccccgctccccccaccccacaacagtccccggtgtgtgatgttccccttcctgtgtccatgtgttctcattgttcaattcccacctatgagtgagaacatgtggtgtttggttttttgtccttgtgatagtttgctgagaatgatggtttccagcttcatccacgtccctacaaaggacatgaactcatcattttttgtggcgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcaccacactgacttccacaatggttgaactagtttacaatccccccaactgtgtaaaagtgttcctatttctccacatcctctccagcacctgttgtttcctgactttttaatgatcgccattctaactgttgtgagatggtatctcactgtggttttgatttgtatttctctgatggccagtgatgatgagcattttttcatgtgttttttggcggcataaatatcttcttttgagaagtgtctattcatatcctttgcccactttttgatggggttgtttgtttttttcttgtaaatttgtttgagttcattgtagattctggatattagccctttgtcagatgagtaggttgcaaaaattttctcccattctgtaggttgcctgttcattctgatggtggtttcttttgctgtgcagaagctctttagtttaattagatcccatttgtcaattttggcttttgttgtcattgcttttggtgttttagacatgaagtccttgcccatgcctatgtcctgaatggtattgcctaggttttcttccagggtttttatggttttaggtctaacatgtaagtctttaatccatcttgaattaatttttgtataaggtgtaaggaagggatccagtttcagctttctacatatggctagccagttttcccagcaaaatttattaaatagggaatcctttccccattgcttgtttttgtcagtttgtcaaagatcagatggttgtagatatgtggcattatttctgagggctctgttctgttccattggtctgtatctctgttttggtaccagtaccatgctgttttggttactgtagccttgtagtatagtttgaagtcacaggctagccacattttaagtgttctgtagccttatgtggttagttactgccatgttaaacagtgcagacctaagccatagttgatggtttttaaacttgagcttgcatcaggatcacctggaaggcttgttataatacagatcgctgggctccacttccagagtttctgattcataggtctgaatggagcttgaaaatttgcatttctaacaagttccttaatgatgctaatgatgctgatctgggaaccacactttgagaaccatggccacagttctttcaaaatccaactttggaaccattttaccactgtattaacatgagtgatcaagaactgtccctaggtattgttgctattgtaccacaatactgtcgtattattgcagtttataaaatattgaaaatctccatttaactcatggttaatattgagtaattattcatgtggatgagtagttcttagatcttcatgtctattactctctgagtgcttctttccaggaggctggacagggaagagacatttattggcttgtttgttcttagtgagtatttacagagctatattaataccatatgtatatgcatgctctgatccttaggtagaaaatagttcttttcaagttgacaaactgtcaatcaataaattgataatctgcccagtatagattcaaggctctaagagcaattagtttgatttttaatgtatttcaaaaacattgaactttaaaatattaagtgaataatagtccactgtttttgagctcagtgagaagttttttaaaaaattacacttcatggttttttaagccatgacatgaatttatctctgaataagttcagagattgtattcaggtgagcaagtcctggccaccaaattgttgatgattctgatcatttgtgaaagatgtagtttcctcctatccctacatgcttaaatatttcatttcccttgttttatttctgaagaaaaacaatgaggagttaatacctgatctttaaactttgtttttgtcacaagagtacaaaaacagcatctgagcctccattggcccctcctgtgtctgaagaagaagatgaagaggaagaagaagaagaagatgaaaatgagccaccaccagttatcgcaccaagaccagagcatacaaaatcagtaagtcacaaaggactatttccaaatgattcaaaagatgccctttggaatagtcatagagttagaatatagttaatcagctagtacctattaagcatcttttatgttccaagagctaaagtataaaatatgaccaaggttttgaggatactgtttgaggatacaaggttagcacattaaacaattagagaataataccaaacaatacataaataactgctaagtaataaaaatgttggagaagttaaggtaaggaaggaaatccatgtaaaccaggtaggaagagttgcataaacagagatcctcagaccagaattagcaaggcatgtatagggacatccaaagactagctcccatgatctttcaacagtgttgtactttcagctactcaaagtcctttttttttttaagaaaataccacttgtctttaaaaattcattgatattacaatacattgactccacactctttccttggcctgctgttttaattgcagagctttttggtttttttagatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagtgagtacttcttgccatgattactttctacacgggagtgtttctcataagccatttaaaatgggaattgatcctttggaagttttaatctgcttatatgaactccagacttcccaaaatcatgagatgaaaaatttgagactcactgcatatgccagaacactttctcccttccactcctaatttgacaggaactaaatatttttacttgaaggaatcaattgaggtgaaaattgataagacaaattaagtagcaagttttaagattacatcttcaaaagagaatagtctgataaaatatgttatgatcataacccaagggctctcaactaatcagtgatgatagatatgtcaacctcaaagcccaacacagtcaatcaaaacttggaacaacaaataatatagctttttcccttaattcagaagcatttatatgtggcaggagagacagaactagcaaatgctagtagcttccttccacaatgtcattagtgtgtacatgctcgtgtgtacacacttgttgccccagttttataaaacacttaccttctagttacttttctgggtcaagaagataaaaaaaaatggattatctgctgaaaagtcaaaggtttgtaaagcatattcattaaactcatactataaaagcatctaacaaattgctagatatcagcaataagtgccccccccaaccccagtttgactaactcctacttatccttcaatactcagctcaaaagttgcctcctcagaagatgttgcttgtccctcccagtccatgttaagggcatctcttccttaccacttttactggagcaaatatcaaaccatattagtctgacttctttactagactgtgagattctcaagagcagggactgtgcccttttttccctatatgtccaacccctagttcatacccattacataaaggcatacagcaaatgcttgttgagtgagtgaatgaaaaaaataagtaaacaaatacatctttactgagttcctacttgtctgttctgtgcaagaaaccttggaggacacaatagaatgaaactttcctgtcatcaagaaattcaatcttttttggaaaatacgatttaatagtatgatacaattagagcataagataatctcgtttcatgcatatttttatttaaaagacctcagaaaaggaagacagtaattcccactataggccacagggaggctctgcagaggtggtggtaggatgattttgccctccaaaggacatttagcaatgtctggagaatatttttattgtcctgattcagagactgctagtagcatataatgggtagaggctaaggatgcttctaaaaccccaacagtgcacaggacggctgccctccatccactttacagtaaagtattattcagtccaaaatgtcaacagtactgagattgaggcatttgagttagatgcatttggaaaggcaaaggtcggagttgcagctgtcagttaaaactcagaactacaattgctagatttttgctgactttactattcatgattaaatatgccactagcactgatactaaccatttgctgtaataacagcagtaataattctcatttattgggcaccttctgggtgggccactttacatacattatcatagtttcacagtaattccttgcagctgattctaatatcctcattttacagaccagtgaatgaaagtaagctttaaaaggcttaactgaccaagtcaccaaaccaatgtgtggcacaaccaaagtttgaactgagaccagtttaccttcaaagcttacactttttccattacctacctactttgcttctgcatatccgaactgtctatttttgtaaaaaggaagaactaaatgaaagaattgcctcgataatttaagttcaattattcagacaattggcacgtttttctttattttgcatatgtagacatgacctatgtgattatatcagattttaaaaatctaacagccttgccttaataaaatgactcttatttggtatctgtttcaaatctcaatagatgtattacaacaaaaatgcttgtatagttttgttagctgacagagaaacaagcattattttcttggaccaaaatcttgttttgcttgtaaactctagtggtgctagagctgtgtccttattattttgtttattctgctctacactgagcaacatggtgaagaaggggaagctaactttgattacatttgaattaagaattcagtggggttttttttttctctactggacttcatgcttgggcatagagagagtcattttccctctagccagcaggccacttgtgactgccaaccttacattggatttgtagattttggcagggtgaacctgctgagaagtggagcagtgcttctcatgaagcagattcagtgaactatactccaaagtccacaaaggcagactttcctgctcctgctccaccattaccctctctgtgccttctctctgccattacgcctttgtctaaggaaaacttcagacaagtcacttaactcctctgagcctcaatttttaacctgtgaaatggagataagaatcataactacatttttgtgagagataacgtctggctctgttacccaggctggagtacactggcacaatcatggctcactgcaaccttgacctcgtgggctcaaatgatccacctcagcctcccaagtagctacaattttaggtgtgcgccaccatgcccagctaaattttttattttttgtacagatgggaacttgctgtgttgcccaggctggtcttgaactcctgagctcaagcagtcctcctgcctcaacttcccaatgtgctgggattacaggcaggagccaccaagcctggcccattactacatttcaggactctgtctataggatggattttaaggagctcatcctatggttaagggagtcagaaggatctacatttaaatcatagacccattgctattagctgtgtcacctagggccagttatttaaattttctgggcctccattttctcatctaaaaagtggggataatgataatataaaaacctcagcagcagtatcaggcacatcataggggctcaataagtggtaattgttattacatgggtataaagccttcataagataatacaatgggtcaagctttgaaataagtcatcactgggtctgagtcatagacttatactagctgtatgtccttagtcaagtcacttaacatctctgaacataattttcttcatctgaaagatggagataataattgtacccatataataggggttgtgtgaggactaaataagttaaagtatataagacatctagcacaataaacagtaatataaaattgttattatgctatttttacagagtgagagtgatcatatttttcagcataaaaatgggggtttggggtcttacagtgtgacagaatgattgaaaccaggaataatcccaggtgtatgattactgtacagaagccatcaagtatcttggactcaaaggccacattggagcttggggaaaaagtagagcagcctgtgctgagaggcaaaagagaggaaaaagggaaacaggcaggcagaaagatggccaatatcccataccagagtggacctcataagcatggtgaagagtagatggcagcctctactaaaccatccttaccttcagtgtcaggggtccagttactaagaggtgggcagcccagaccacagagctattcatcttccatgcagatgctgattgtggtggccagagcaagaggtcattattgggtgaaatgaacaggtcatctttcagttttacacagacaaatagcctgggtctggcttgttcattgtggtctgtctagatctgttgaaaaatacagaaacaagaacagaaaaccaaacactgcatgttctcactcgtaagtgggagttgaacaatgagaacacatggacacagggaggggaatatcacacaccggggcctgtcggggagtagggggctaggggagggatagcattaggagaaatacctaatgtagatgacgggttgataggtgcagcaaaccaccatggcacctgtatatctgtgtaacaaaactgcacgttctgcacatgtaccccataacttaaagtataataaaaaaggaaaccaccacattttagtgacaaatttcaaaagccattactgtcagtaaagttgtgtaatacaggaaatttgtcttcaacctccttcctctgggccccactatcacctactccttgcctctcacctccctcagcattccccactcaaaaccctttttcctaattcaccctcatatagaactgatatcaatttagagaatctttttactttttctcagaaatcaaaatcttcattatgctaaaaggataatcttttaatggtgggagttcaccttagcttaatatgtcagaaaatatattgatgggcttttctgtcactgaactcatatcatgaatgctattttcaaatacaagtatttagcattcttaaaacctgcactttaaaatgaatagtttatttcttctttaggaagttctggtaggaaattgttctggtattgcttttttttcttttgattttgatttgctgattttaaaaaactttctccctattgtgtcacagtgttttttctttatcgtaatttacaaaagcaaattataataactaatggaaaagatcactttaaaagcttgttttgtgattgagaatggtaaacaaggcctctagtatacttgcctaacatcagtagatggcagcacacactctcctgtgaagggcgatgagtgtggagacaccattttatttgaatagcagttaagttcagaagtggaatctcatcaaaatggtttcttttggtaatcttcatgaaaggatttatttccagttttttttccccctgcataacatggaaataaaggttgaataatttattaccataaagccacattaactgaaccccaccatttggaatgggtcataattcagaaagtggcttgggctgaagctttttctatatggaaaaaagttgcttagcaacttaatagttaaacttttttagaagactataaactgcttaataaaattatggcttcaagtgactttaaaatcgtcatttcattaaaataaaaaagtccaggcccttgcgcattaatagctaatttgaataaggatggctctcagttatatagaaatctgttagacaagttgaaaaataaaagaccaactcagaaattgctaaattggtggcattctatagatatagctcaagtaaaatatattctccaacccttgccttaaaccatggagcatttacaaagggaaataactaattgtattttattgtaattcagcaaatatatcaatatattctacacacggcattgtgtgaggaggcactgaagatacagagatgaataagacatggctcctgtacttaaagacatagtctaaaaggcaatatcaaataccatacacacacaaaggaacctatgcagatgactgtttagtacagagagtaactcagcacaagtgttacattgtgaccaagaccttaagtgaaccaggaagatctgtggaattcccgtcatgtatatcatgtacatttctagccatagatacaacattgaatggatgccagatgattatgaaacccttcagttctaattcttacaagtcaaagttccaaatagatagatatagacatctgatatattaagtacagagagagagagaacaagggcgagagagagagagagaagatacagtagtagcacagaaaagtgaagttgttaattattcaagggatcagagaaagcttcctagaagagggaacatctaagctaagtttggaagcatgaataggaacttgccacagagaaaatatgggaaggacatttcaggcagcgaatggcatgtaaagaagacttgaagcatatgtcctggaactctgacttattcagtgttactttaataaagaattggtggtatatggtgatactggcattgtagaagaggaaactgaacttttaagcaggagctgatcatgagctaccattagtttgttatgcttagagcataaagttctagtggggaagtggtaaatgatgagaagagaatgaagcaggagccagattaggaaccttgcattgccaaggagttttggctttcatctgtaggtgttagggagctatcaagtaatcctgaaccagagaatcacattatcaggtctgcacttagaggatcctgatagagatgtagagccttgactaaagagggcagcagctagactaggagtccagttaggaggctgttggaataacccaggaaaaagatgatgggagcccaactaaagcagtagtaatgaggaaggaacacattcaaaagatgtctaggaggtaacaagatataggcccttggtggacaactgcacgtggtaagtgaaagtaagagtcaatgatgacttgcagatttctgactcaggctactgagtagatggattggcagtactactgactgatagtggaaatacaaaagaaaaagtattataacaacccatatattagctaagtcttatttaacttaatttaaaagtgaactttcattaaaaaaaaaaccaacaacttgatgagtaatctatgagtgaaatgtttaactgattatttttctcaaggtatactatctactgctgttaggtctaaattatgttgtatactagcccagagaatagactgttgtgtaaattagcatgaagtattatctgtagcatataattgagcacttaaatacatattttcttgttctcattcatttaatcaacaaatatttgtttagtagcagccactgttctaggctccaaagttacagggatgaaaggacaaagttcctgccctcaagaagcagcatgtaagtctcagtgaaatgatcagagaagacttcataaaggtggataatttgagattttatttaaatgacaaataagaattcatgggttagataggaaaggaaaagggggagcacatgcaaagccctaagcactagatagtgatagcattactaggatataaagtagtaagggtggagaaaaagaataatataaagctagactggttagataggagccagatgatgctgaagggtgaaggaccttctctgtctaactacagaaataggatttgatcctgcagtgggcaggagcttttaaggaattatgaacagtggagcaaaatcactctgatatagggttattgtacatctcagtctgtccaggacagactcattttatgaatagtatggtcccccttttccaaaggcatggtgtaagaggaactagagaaagcagagtctatgagtaggttatgactggcacaattgtttgaataagaagtattgaaagcccgaacaatagcagtggccatgggcatagagagaagagtatgaatacgagtgacaactagaagatagaatttacagatcttctcttgattagttcatatgtgaaaatcttgccttaccaaccaactgtacacttctttgtaccatgtgttagtaagatataactcaaagataataatactgacatgtttgcttccagaaagaaaggtgggccagaggcctccaaataaatgatgcccttcaaagtatacccttgagaagctgcacccttattcccatgattgttctataaccccaagatttttctggacctatttgaacactgcattgaagagtcaatgccacttctgtggtatttattctgagtgatagcaagtattcatcctctgagtgatggactggatttttttgaaatagcaaaactattatttttaaagagccaaacatgataaattaatagttttcttatgtagcttataaacttactaaaaaaatgtttggagcaatctatagaaacagaaagtagattagtggttgcctagatatgttttgggaactaagggaagatggggagtaactgctaacaagtaagaggtaaaaggtttctttctggaataatgaaaacattctaaaattagatcatgatgacatttacacaactcattaaatatgttaaagacattcaattgcacactctaggtcactgaactttatggcatgtaaatcatatgtcagtaaatctgttcaaatctttggagcactagcagtgtcctaggtttggaaatatatgttttgaacatgcatgggtctcattactttatgatcaaactttgttcttcattagactcatttccatccccacacccttagcactgtactaggtacatagtaattactcaatagatatttgtccagcagaattggatatagcatagtgcttaacttcaattcagagaagacagtgattttactaaatagtgtggataagttcttagattgttttttagcgattataccaatttatgtacccaccatcagtgtacaagggttccaattgctctacatcattgatataacgtttggtattgacaacctttttaattttagccattctgatcggtctgtagtgttaactcattctggttttattgtatattttccagaatgtttatgagcctgagcacatttttgtattttataacttcaacttttgttatagattaaagggtacacatgcaggtttgttacatgggtaaattgtgtgatgctgaggcttgggactctaatgatgccttcacctaggcagtgagcatactacccaataggtagttcttcagcccttctccctctcctctcctgcctagtgatccccagtgtttattgttcctatctttatactcgtgtgtattcattgtttagctcccacttataagcgacaacatgcagtatttggttttcttttcttgcatttgtttgcttaggttcatgacctccagctccatccctttcttagattttttttatatcctaatatatagtattatgagaactttttatagatgttgggttgtgacaagttttttttgttttccaaatatcagtaattttgaatataagcaaaatgggttattattactactttaattactataaaactatttgttattttaataagtagaaagtatcatttttatgtaaattatagaaatcccatgggagtatttgtctaatgttttatttgtcactgactctggcatcttaattttcattattaaattaaaaaacagtcaatcaatttctatttctctctctctctctctctcttccacctcctcctcttttcttctctccccacccatctcttaggaagcattgtgagtgttggggacccaaagaaaaaatacacaagatttgaaaaaattggtcaagggtaagtgattgttatttgaaatataaaaagatgagtacaagcaacatacattaaaattaaaattcagtaagagcttgggtttctggtaaattatgcttctcatttcctagattatatttatgtcttgcattctcagtattggcctttcagggggagtgctgacaacagttacaacattaacctaggaacacatcctgctgaaatcttcattattgttgggctgacagtaaattctgtgtggacattttgatcctatgtagttagaagattcaaacagatttctctagaaaaagcagtagggttatggaaacttctagcttacgtaaaaaccccctttatcgcagttccccctacagccacatggatggtatgattaagatcctgttttattgtcaaaatgtggagtgacaaactgagggtggggaatgtccttatggaatgatccggaggtaggcagagttgactatctgagtatggaggaaacagacaataatccctaaatgagacctagtgcatcattttcacttaatatacttgttaaagataaagattcccaggccccactgccaaagatttgatttagagtctggagtggggttcagtgatctgaactttgcaaaagtccctcagataatcctgataatcagcaatacatgggtaccattgcattagattattcactaaagctgaaggcaggagtcaccagttctgcaagtcaactgtactaatgcatgtctctcaggcctcaaagtgaaactaggcaggtggatctgagcaggcaacagcatttgaaacagggaaaagttttatttaaaggaaaatggaatattcttaagggacatccttaaatgaggagtgagacacatattcagggacaccaactactgtatgtcagaaacaaagatggcacctcagacttttcctggctgaggcaaggggctgaagacaaagggttacagccaatatgcttgcaaaactgtgctagccgatcagccattagaatctaattattttagggtaagagaaggtagaatttcttcaagaaccacactgcttttcctggcatacttaggttcaaaaaagtatacatcatatataagcttgactatttttcatgattttatattttctttgtttttccccctagcttttgtactaaagtttcttttgaaattgccagtatatctcaggaaataagggaaagcattcattagacgtttgggctagagaaaaggagaggcactcatggaaactgtgcctggtgggaatcaagatgagaagaccctaagggggacagaaactcaggaagaaatgcatggccaagtttattcttccagtcaaaaccataatgacattgtatttgaactttccagggggctaaaatatattctcatttgctcacaaaaaagaagagttttatggtctctagaagcttcctgtcaccgaatgggtcaaattaatatttctactcattgttctaaaacagtgataaacaacagaacttactgtgatgatagagatgttctatatctgtgctgtctaatatggtagccactggctatgtgtggctatggggcacttggaatgtgggtagtgcacataagaaactgaatttatgtgaactcatttatttgtttagcagatatttcttgagcactaactatgttccaggcactatgctaagtgctagagagacagagatgggtaatgatggtgtgggccctcaaggaacttacagtttacactgataagtgcttgacagagggatacagggtaccagaagaacctagaggcaagcttactcaattcaaccaagtatagagcagggccagcttctagagccgttttctcccaccgggaattttccctgtctacttctggtggacttgttgttttgcttaagtaagaaacctataccttcccaagtctatatacagacctcagctctccttcttcatgcctaaagggtaaataccaccagacagattgcaaaaagacagtattatgtactaaagggacttagaaaacaaaagttggcttttagatttcattttcatctggatgagtctcaggtggagctaacaataggaagggaagggatattcaatccacttagaaatagcactccaaatcattgttgtccagtatggtggccagtaaccacatttggctactgagcacttgaaatgtggctagtccaaatggaaatgtacttaagtataaaaggcacacctgatttcaaaaccttagtatgaaaaaataatgtaaagtatctcattaatatattttttattgattacatgttgggaaattttgcatacattggattaaagaaaatatattatgaaaattaatttcaccttttaaaaactttatgtaactctaagaaattttaaatatggctcgtggctcatgttatatttctaataggcagtaatgctctagttgtagccttaactgggagttatttgtttattaattcgtaaagtgtttttccatggttgttttttggagagtgggagatgttataattttgtcttgattgttccaactaaaggccaactgagccaaaaatagcattgaattttaaaaggaaaaagtacaagatggtttcagatacctcccagatactaggtaatgaaacaagactaattttgccaagaacaaagatcaggccaccaagcaactttgtgtaacaaagagatttcctctcttggctattatttatgcctgtgacttttaaagatgaaaaggaaagttctctatctctgagtctctttgtacagtcttcacaacctaaaatgaaaaaatcgaagcataaatcctgcttgccactgcagaaaggtctattttaaattcccagcaagttcatcattttaaagaatgataaagtagcagatagttcactcataggcccaacacaactttttaatacatccttagagggtatggagtcaattgtattcctacttttgtcttctttagtgtttagcacagtgcttttgcacttagtaggccctctgaaataattttgtgcagttatgatcaacagctgggttcactttggccagattcaaagaactgcaaagctgtctgccaactccgtctctgtgggtctgtttttgcctcaataaatatttgttgagctaatgaaaatgtttgtctttccactgcatcttctcactcgtaagtgggagttgaacaatgagaacatatggacatggaggggaacaacacacactggggccagaaggggaatggggggcgaagggagtgagagcattaggacgaatagccaatgcatgcggggcttaaaacctagatgatgagttcataggtgcagcaaaccaccatggcacacatatacctaagtaataaacctgcacgtcctgcacttgtatcccagaacttaaagtaaaattaaaaaaataaaaaagaaaatgtttgtctttctagctatctctttcctctgtcctctgtatttacatgtgtatatacatgcctatcttgctcctcctgtgtctgtctttccctgtttttcctcagtgtgtcttcacatttttgtctttcacaatgacttgattggcctcaccacatctgattcctttattctctgggtatttgtgtgtgctgcatatctgtcttcttcaagcatgttggccttacattctactgcccattttcacacacaccccacaacccaaattgtcataatataaaatcaagatgtatttaagatataatctgccggcttaaatctatttactatgattttatcatttacttaatttactaattttatttttttgatcttagtagattgtttttcctcagttcttaattattaaagtaaagcaaaatattgacttttttctttctggaccaaaaaaaaaaaaaaaacccacctcccacttatattaactttctttttacttaaatggctttcaactgatttttttttcattaattactggcctaagttatataaactagtagtctctactctcaatatgtagagttttttaaaattaaatctgtgtttttaattgtttttgccttacctattattacagtgacattcaaaattgttgtcaataatcatttggtgttagggataatcagccccagtattttattctcagctccagagagcacaacagttcactcactctcaggagctggatttgagaagagcttctccattaatcaccttcatttacttggaaaactaaattttttctccagcatgggtttctgccatcccagcattcaggcctggggccagagaattgggctccatcttccataaatcaagttcagaatcacatgtctaatcgtttgaggccatatctgtgagttgaaggctaaaaatgacattgtttcactgggtttgctgtgaaaagtgttctataattggctaccaaatccagacattttgagcaaatttatgcaaagttaaaaaataaggaaagaaagaaaaaaagtcaggtaccccaaaattatcattaactcaacaacatgagtttgtcagaaatatatccggtgcgcacttgagaatcttcactttctagaatagttatataaaataacttgtttaataaatgaggtagagtgagacaacaaagtcaaatatttattttcagtcaacagctatcaatagcaaccctgtgtaattcctgaataagcaatagctatgtaacagagggctgaatttacaatgttggcagctgtcctcacagatttctcattaatgtatttgaattcatgttagggtctttccttaaatgagaatgcactgaaaaacaggcctttttttctctttcaggttcatattgtcttttctcttcaacattataatagaaaaatatttttgaggaagcagctcagaggatccagtttaacaagtatatttttaacatcaatgaacctttaatgagtgcctactatgtgtaatggagagtagcagttaagaatcaggttctcagagttcacagtgacctctatacttgtggtccccctgaatactggacatggagaagagttatatcaagaaataagatgaacacctacccccaataatgtacctttcctctatattttattcatacactcatcttcactgtcatctctcatatgaatcactctttggctggcctggtcctaattgaccttttctgtcttttgtttttctgaatcctacagattatatctgtgccggcatgtattcaccacttatatcttagcttgtctagacatgtaaaattgcttgaaactttgaggaatgtagaggaataaagggagaatttttgaaaaacttgaagaaaaagaaagagacaggattctgaactcagggctgtagaaaaattatttaatttctttaagcatcagttttctctttcatagtaagcagaatgcacgtatctcataaggttgtaaaaataaataagagaaggcatttaaagtccttagcacagtacatggcacatagttaattgctcagtaaatgctagttattattagggatgaaagacacactcatatgttgctattatatagaacagaatataataagtattgtgaagaaattacaaagatctctgtggacagagaggagggacaaattatttacagccaaggagtgggtatgatggattcttagaagagggtacacttgagagtgacattagagggtataggaatttaacaagtagggtttataagaagttttgtttgaatgcttacttcagactgtaggtttcattcactttggtatccctaaggtctgcaacactgccccagcatatatgctcaaatataaggtaacacaataagataattttaaaaagttttttgatgcacctgcatacataaactgttttatatatatatatatatatatagagagagagatatctgtatatctatatatctatatatatatatatatatatggttgaaagtctacttatgatgtttgttaatttactttcattttcatatttaaaaccacttatataaagtattattttgtagagatttttctactctcatatttcacgagtggtataattcaaaatcttcttatgtgtctttaacatcattctttttgtaatcactagagattatttttgagtcttccagcagttactcaaatatattacctgacttccatctaagatatttgagattttgaacccacatataattctgttcgtggatatttattcctagtcacaattacccattcatataacattaagactattgttttttgaatttgtcctgtaggtgtatatttaggtcttcatgacatatatctactatctactatatgactttttaaaatttctattacaaattgtcatacttacacaaaaatagggaaaataacacaggaactactgtattcttatcactcatattaaatatttatcaacaatttttaataaaatcacaatgccattacatctacaaacaattaacaattgcttcatatcatttaactcccagtctataatcagaattctccacttgcaacaaaacgctatttttataattgatttgttcaaatcaacatccaaaggagatctacatattgcatttgttgtatatcgtaagtctgtataccctgaagcagtctcctttctttttccactaccattatcttgttgaagaaactggttattgccttgtaaaatgtggcactttctgtatttgtctgttagtttcattagctgtcatttaacttgctcttctaacttccacctctgggattcaggggattctcttgcctcagcctctcgagtaactgggattacaggcgtgtgtcaccatgcccggctaattttgtatttttagtagatacggggtttcaccatgttggccaggctggtcttgaactcctgacctcaagtgatccacccacctcagcctcccaaagtgctgggattacatatgagagccaccatgcctggccagatgcttgcttttttaattgccagctttcattgtaaagagttagcatggagttacatacgaaagtgttcaatgaggggtattttgatatttttagtagggaaattttattaagtatctttataaagtcttacaattttacattgtcaatatgtttcactgagttgcatctattattgtttatggtggtcaaactattccatctttagctaatgggagaccctttcactgcattagttttgacagaggtcttttaatagcttgtttacgacatccaacacttgcagttatgtggtcataccctccaaaataacttattcacatcctttctttgtaattctgacaggtactctctatgagcatccaaaactagcattaattgagaagatatcaacctaatatgtcctttccaaactgtattttatagttaaaaataaatgaatatggataagtaccaatcacatgaaagatttttataagaacttgcatataaggcagctccatttttatgaggaaaaattgggaggagaaaacccttatcttgtatttgggtatatatggtgcatttctgtgcatgcatgtatgtttgttgtaggtatatttttagcacaagtggtaacatactatatatctccttttttattgtgtttctgtgttttagagatggttctatgcttgtacctcatactttttaaacagatgcagtgctttgttatttgaatagtaccataatttattgaactaggccctaaatggacatagacatttaatttgtttttgatgttttgctattataaacaaggcttctgtgaagatccttacaaataaaccattttatacaaagttatcattagaatagattcctaaaagtggaattgttatgtaaaaggatatgtgcatttttctttctgagttaccctccttagaggtttgtttatttaacacaccatcaataatgtatgagagtgccggtttgcctgcacctttgccaacacagctgtattcacttatttgggattatagtcgtataataaaaacactcccacactgacttttttaaaaaggaaaataaataagaaaggaactctaacaagaaagcatgtggcaaaacaaaaggctatcctgaagaattaattagccaatgtagtccatgtctttataatgccaaagtatctttgttacatgttatatctctccataggttagattagctatgcagctatgtttgacagaaagtgacaatgagagcatttcttgaaatcatttttctcttacacgtagatatatatctgggcaaaggaattttgtctaacatctggatctttgtcaatcatatcattatatagaatgatgatatgttcaattcatcaataattgctaacaaattttgctactagctcatgcgtaatcaagccctcagtcccccccgtctctctaaattagttttagttttaagactacagaaactaagtatataatgttaggtatttttcagacttatctctgctactcagtgagaagcccctttcttcttaatctaacatgaaagtctcatattgaagatgaatagctttgaaacttatttcttaaaagacttgttgaataacagtgtcgtttagagaacctgacaaagcagtgtatgccatggaactcagagtgctgagaataaaacctctgattttttttttttttttggttgttcaggaaactatgggcaagagtggtgtctagtgtgcttatagaagtgattctttgggtaggaccacccaccccaaaagtatttgcttcttcatcggatctattttgggccacacaaggtagaacgctgctatgaagcactaaatagatgtagtctgagttctataaaaggctttgtgatgtaggagattggaaatacattagcatttgtgaagaacaatgtttatggagcaatggaagatgctctttgttctacttaatgctcttaaatgcactgtgttgtgtgctgtcccttgtaaagaaagatgatgccactcaatcaaacaccattagcagagtttgcacgttaacttgttttttccagccacagtaatgagcttgttttaagccacctgcccccctttcctgtccaggcctcttgaatccaatggcacacactgtgaaacagctgcttagatttaatgttggagtgagtagccgagagttatctggcctttccagggattaagccttgtaattgtggcctcattatcactggactataacccaccgagctccctggccccacacccataatgtgttacagctctctttaaaattagatgaccgtgaatactctgagaaaagtcatgccctagctaaagaacagaaaattccgtgttctgatttataatcttagtaattaaagactataccatctggccccagctacattctgtgtacttagagcagtactgagataacatgatttttacataattttcttttttaaatttagggatgcattttttagaagtaaattacacaaaggaaaacgccagaactctgtctttggaaaagttattgcatgtgatggtaacatcattcctgagccccaaagaacacatctctcaacaaaacaagtaactatatggtagtatcaaactatatatatacagatatatatagatatataatctgtttttatgtcaggtgcgttagtatagtgagacaatatctagataggagcctacaagtagtaacttttttaatattcagcaaaagataaagtctatttctaaaaactaacagcagttcattttcagccacatgatcaatcttaattgagtcggcaaacagaacaacaacttgtgtgtggttataccaaaggaataaaacataccatgtcctggtacaaactaaatggcttgtggacaaagtgagtagaaaattaaaggcaagataaacattttggggaggcggcttagcataacaggtacaaacatgagctttgggaagtaccacacttgcacttagcactgaggtaaaaatgctaaagatctatagcaaaacatgaaatggtgattaagagcatgggctgtggagagaaagtaatgcatttttaagctcagctgctgattgtgcaaccttaggcaacctacttaacatttctttgtttcaatgtcctcatttgcaaagtgaggaaaatctaatttatctcatagagttgtacagggtgggcattaagtgagatcattacagagagctgcagagagtatggctcaataagtgaaatagcctttttatagcagcagcagcaataggaatacatgtaaaaaaaataaccattctatatggggtttaatccttgactatgacctcattagcaccagatttatatttgtaaaaccttaatgggaattttgcctatctttctggctccctcattcttattcctaccagattcttcttggacttcattgagcctttagacctcttgccctttttgttttctcccagtatatgagcttcttcctaggctcacttcttcacccttcttttcctctaatccatttccatgctgaaatcaaagtgacttatctaaattattagtcctaccatgttgctacttttacaactactcatgattatggcttgacattggcacttggtgggaaacatcaaaacctggtcaagattcctgataatgaaactgacctgctttatgaggaaaagggagaattgtgaattgtttctttctggacccttcaggctagatgccagtgtttccatttgagtagtaagcgcttggccatgtcagggagagactgttgacaaagcatctaatgtgatgccaagaacccagatgtacttatcgcattttaattgatgatgggtcccaatggttgagaaatctgttggtttagtattctttaatcatagtatagttaactgaaagatctctaacttcaagttaggagacctttgttacttacttgctatgttatcatgggcctatccttcctgctttctgggcttcagatttctcatttgtaatgaggaagttaaactggatgttctctattttcctttgagtcctgataatgcatgattactttgtactatctgagggattgagatttggaataaaaacaatacctatcataaaagcatgttcttcctacaggaatctggctttaatataactggaatggagtgataatagggatcaatgtaattaaatgtttagcataaaaatcaaattgacagtgttgcccattttagcacaccagacccaatacactggagaattaggaattttaacccctatctttgttagtttgagttttggcatctttacatcctatagtgctgcgtgacactgacttttttttttttaattatactttaagttctgggatacgtgtgcagaacgtgcaggtttgttacataggtatacacatgccatggtggtttgctgcacccatcaacccatcatctacgttaggtatttgtcctaatgctatccctcccctagccccccatcccccaacaggccccggtgtgtgatgttccccttcctgtgtccatgtgttctcattgttcaactcccacttatgagtgagaatatacgttgtttggttttctgttcctgtgttactttgctgagaacgatggtttccagcttcatccatgtccctgcaaaggacattaactcatcctttttatggctgcatagtactccatggtatatatgtgtcacattttcttaatccagtctatcattgatgggcatttgggttggttccaagactttgctattgtgaatagtgctgcaataaacgtacatgtacacgtgtctttatagtagaatgatttataaccctttgggtatatgcccagcaatgggattgctgggtcaaatgatatttctggttctagacccttgaggaatcaccacactgttttccacaatggttgaactaacttacactcccaccaatgatgtaaaagcattcctatttctccacatcccctccaacatctgttgtttcctggctttttaatgatcgccattctaactggcgtgagatggtatctcattgtgatttttgatttgcatttcttgaccagtgatgatgagctttttttagtatgtttgttgaccgcataaatgtcttcttttgagaagtgtctgttcatatcctttgctcactttttgatgggattgttttttttcttgtaaattttgtttaagttccttgtagattctggatattagccctttgtcacatggatcgattgcaaaaattttcttccattctgtaggttgcttgttgactctgatgatagtttattttgctgtgcagaagctctttagtttaattagattctatttgttaattttggcttttgcttccattgcttttggtgttttaatcatgaagtctttgcccgtgtctatctcctgaatggtattgcctaggttttcttctagggttttttatggttttaggttttatgtttaagtctttaatccatcttgagttaatttttatataaggtgtaaggaaggggttcagtttcagttttctgcatatggatagccagttttcccaacaccatttattaaatagggaatcctttccccattgctgttgtagatgtgtggcattacttctgaggcctctgttctattccattggtctatgtttctgttttggtaccagtaccatggtgttttggttactgtagccttgtagtatagtttgaagtcaggtaggatgatgcctccaggtttgttctttttgcttaggattgtcttggctatataaaatttcaggccaataccaatgatgaatattggtgcaaaaatccccaataaaatactggcaaactgaatccagcagcacagcaaaaagcttatccaccacaatcaagtcagcttcatccctgggatgcaaggctggttcaacatacaaaaatcaataaacgtaatccatcccttaaacagaaccaatgagaaaaacctgattatctcaatacatgcagaaaaggccttcagtaaaattcaacaccccttcatcctaaaaactctcaataaactaggtattgatggagcatatctcaaaatattaagagctatttatgacgaacccacagccaatatcatactgaatgggcaaaagctggaagcattccctttgaaaaccagcataagacaaggttgccctctctcaccactcctattcaacatagtgttggaagttctggccagggcaatcaggaaacagaaagaaataaagggtgttcaaataggaagagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcctatacaccaataatagagagccaaatcatgagtgaactcctatttacaattgctacaaaaagaataaaatacctaggaatgcaacttacaagggatgtgaatgacctcttcaaggagaactacaaaccactccttaagaaaacaagagaggacacaaacaaatggaaaaacattcaatgctcatgaataggaagaatcaatatcgtgaaaatgcccatactgcccaaagtaatttatagattcaatgctatccccatcaagctaccattgactttcttcacagaattagaaaaactactttatatttcatatggaaccaaaaaaagacaccaacttttaaaaattaaagtgaattaaggttttattttgtaaatatatgcatggagatattttgatataccccaggccgttgcaaagctcatctttgggaatcagcacaacatggttggcatgaagattgtttctttgggagtatacactactgtgcttcagttattacaaggagagtgcttcccaacttcaccaagatcccttcaattatttgtctttgtaaaccctgggttataaataattttgatgattgaactgtatttattaatagtttatttattgtactttattaagcaaaaaatacatataactgctaattaaagcttttaatcatcatgtgatatccaacataattacaagttgatataattctagctaaaaggaagtatatgtgatatttgaattagctgttctcaggtaattgtcaatttttttgttatgaattttgaaacatcaaatatcttgaaaactcccagatacttacagagcttccttatgattcacacactagaatttgagaatgtaatgaatatgttaggaaataatcaaccaaataataattatcattactgctaatatttattgggaaatcactgtatgccagaactatatacatttaatcctcctttaatcctaaatcacaaagaaactaaattacttacccagagtctgacaactaggaactagtagtacttgaaccaggggaggtttgaatgaatgggagtgaggactactgttctcaacccagcagtgagcaatgagagagctttaatagatgaatcttgaaggaagttgagatctcttgaaggagagattcatatttatacccgttgaattttaaattgttagaatatgtaaaagcatcagaactggggtgcagaaatatgttgggagtgctaagacagagctggggaaaaggtggtaaattttaatttgcaggttagtacctgaatttgtgcattcgagttgaaggttgtgcaaaggctagaagttgcacaaaccaataacttattggtcagagcagggagttccaaccacctaacaacatgtttggtttgaggggattggtaagtgtggtaggagaggatattaccattttatgacaagagaaccagggtacagggtagggaaatgcatatatatatatatatatatacacacattacacaattgcatatatggagtaagcggggaggggaggggaggagaaaggctcatttttagttagcagctggtgctctagagtttcaggatatttaaacctctgtggattagtaatttgtcgcaattttataccactggatgccataaatcccaggatattgagattccagggttagaactctagcaattttaatacaattaaatgctgagggtgctggaggacaaaaaaaaacaaaacccacgaatttgaaaggtaaagctctgaaaatgttaaacatgaatccccacttgcactccaagtcaatcacaattttagccctcaggacagtgggaatgggcttgggggttagggagacagaggtgttgaataacagaaagggcacctgggcaggtattttgggcccccctccctagctttaactggggcaactcccaatttatttgtttaatatattgagggtttcttcatacagtttcatttgataaaggcgttccaactttcaaagaaaagggtaaaaccacttccctagggggggagaaaggatgtggaacctctaaaacgtgttccaatagtttacctcagcctctgtccttttggaaataggggcagatgttagcaaggatgctttggctgggaggtttggatgggccaactaatagttcggtgtaccagtcatcccctactgtgaaaccaataacaacagcggcaacaacaaatgatgataatagcagctaccatatagacatcaactctgatctggcacagggctaaatgcttacatagattgtgccatgcacaatctctacatgtaattctctacagccctgtgaaataggaactattatctcattttgcagatactctcactcttttgcatctaaaggaattgtgcatgcggcctaaatacatgtgaataaaccagagtcacttttatttatttatttttaaattttattttagatttagggagtatatgtgcaggtatgttacctgggtatattgcataatgctgaggtttggggtacgaattatcccatcacccagaagtcagcatagtactcaacagttagtttttcaacccttaccctcctccctccttcctcactctagtagtccccagtgtctattgttgccagctttatgttcatgcgtacccaatgtttagctccagcttagaagtgagaacatgttgtatttggttttctattcctgcattagatcccttagaataatggcctccagctccatctatgttactgcaaaggacatgatctcattctttttatggttgcataatattccatggtgtacatgtaccacatttttctttatccaatccagcattcatgggcccataggttttttccatgtctttgctatcatgaatagtgctgcaatgaacatacaagtgcatgtgtctttttgataaagtgatttattttcttttggatacatacccagtaataggattgctgggtcaaatggtagttccgttttaagttctttgagaactctccaaactgctttccacagcggaagacctaatttacattccctccagcagggtataagtgttctcttttcttggcagccttgccaacatctgttgttttttgactctttaataattgccattctgactggtgagagatggtgtctctttgtggttttgatttgcatttctgtgatgattattgatgtggagcatttttttcatatgtttgctagctgtctgtatgtcaaaaggcatttttaaatcatattttgcaattagatttaagtagtttctcaggacttattgcggctgaaatatacaccaagtcgaggtgatctattcctttgaactcaaataagttcagaaggacaaatcacacaccgggctctgaagtcaggaatgtttgttcgcttattccaagagcaaagtgctttatttagatttaagtagaagaaatgttttcttcacagaaaggaaaagtcatattggcattgcatgtttgctttaaaagatttttattaatttgttcattcaacaaatatttattgggaactaactgtgagctctgagcccagaatctcacacttacagaagtgaggaaatgatttgtctgatataagcctcaagcctaagaaatttctagaattatcaaatcccggtttaggtggcacctattgattaagtgtgatttttcagcccagttccaatcgatatttagaaacacaagcagagtgaggagggtagtagagttgtagattataaatcatagaattaaagaaccttagaaataaagtagctcatttcctgtactttaaaagcaagagagtcagacagacacgggttgttaactgtgtaaccttgggcaggtaacctctctgaacctcagttcatcatatgtaacatgggaataatagcatctgccttataaaaatatggtaaggattacataagataaattatctaaagttcttagtgcagtgtctgacatatacaacatactcagtacatgtttactgttattgtgatacctgttttccatgtgaggggactgaaactcagtgaaaggaagtaactagcgcaaagtcacatagcttgatgatgttaggacaaatattagaactcagatctctactaatagtcaaatatgccttatactacacaccgagtttactccctgagagccaggtcatatacacttcctggacctgtgagaaatatttgggctaatacaaggagaagggaaaagaatgacaaggaagtgcctgacataagaaaataattcctggactcagaaaacaaaacagcaaggatgaaataaagaacaagagaaataattaccagaaagtttacaaagcaatgttggagtattataacatgtagtcaatcacaggactgatctctattctaactcctttattcactaaaagcgaaattgactttttttctttttcttgaaggtgttggtgggaggtggtttagaatgcatttgtgattcatagaaggttactgtgaatgcagcttactatacaatttctatttgcaaagcaagggaaccccataaatgaagttagaatggaagcaagagtactgctaagatataaagaatgatacattattaatttttttgagacatggactggctcattattaatttttttgagacaccaggctggagtgcagtggcacaatcacagctcactgcaacctcgacctcctgggctcaagtgatcctcccatctcagcctcctgaaaagcagggactacaggcatgtgccaccacacctggctaatttttaaatttttcatagagactggatctcaccgtggtgcccaggctggtctcaaacttctgggctcaagcaatcctcccgcctcagcctcccaaagttttggggttacaggtgtaagccactgcaccaggcccagaaatgacagattttaaaagaatattgggctggagtgacacctcaaagtagaagttgttgagaaatttagtaaaaataagaaaacaatggctcaataataaagtcatgttgctattgcttcatgtagctatagtacagtacagcactgagagagattggtctttagatgaagatagtcttaaaaattggaaatatatgaaaagaaccactcggtttctatactaaaagggaaggttaatttatacttgcctaagcaaaagatgatatattctttcctaaactattcttcagtttaatgaaaggcctgcaatgttggttattacaaaattcaagaaatatttaggggattccaggagtttcctaaaagaagcaaggccattttgctcaatttattactgcatagtgcatgacactcagactagtgccagaaaatctgactggagttcctagtccaccacaagggatacattgtgattgtttcaggtgcatatgctgtataaaaagattgttccaatactgtacacttaaaaatttgttaagagggtagatcgcctgtgtttttttttaatcacaataataatttttttaaaaggttgttccttttcttacctcataattttgagtttgctaattttcctcccctcaaaataattacattttatttcaagtaaaatatattggtaacagcttgattgcttattcttttgataattttcaccttcacagggcatcaggtactgtttatacagcactagacattgcaacaggacaagaggtaagtgctaacgttcaatcctgatttttattttcttttattcatatttaacagttatcttcttcgatggcaacttcgcctaaaaaaaaaatgggtagcactgggttgacataggtgtttacttccttggtgcccaaagcctctgaagtgagtagtttacccatgataaccaaaaaataaaaaaaaaagtggggggcatgtgtttgtggcacagggaaagagcttagtaaataaagaatgtgtatgtttcactctatgtcccccaaaatatgaatattcatgtttattataatgattgtaattcattcttgtattttaattgccattcaggtggccataaagcagatgaaccttcaacagcaacccaagaaggaattaattattaatgaaattctggtcatgagggaaaataagaaccctaatattgttaattatttagataggtaagtgttttgtcttattatgtacttatattctttgtgggatgtcattttttcttggcaaattactttatttgggattcgttcatttaacattctgcaaatatttctcaaatgctacagtgtagtagagtattagatctattgctaaacttgcactcacttagctttgtccacatatcagacacttgaagaaacattttatggtcttggttgtaaatttcattttgagaatcatagctccattttggcagaaaatagaccattgcatataggagggagtagtggtttaaacattacatcaagtgtttgtctggagccagtacaatttctgggagtctaagtgaagaaggctgactacaatggctttaatgggtgctttgtgattaactaacagtgaggtctagggaattcagactttaatctcaaacctttttcctaaacctggtaattaatgtctctttatcagtggtattaacagtgtgttataaataggtatttaaaggcagcactaactcttcacttgtggttaacatctgtctcattcaatttcaaaaagagtttgtttagtaccactgtgcggtgttctctggaggggatacaaagaaactaaatctaggtcttcaaactcaataagcttaagatactgttttctgctttttgggccaggtagaccaatgttacagaagaaggaaaaactgggaggaaaaaagagggttaaattttacagtccttttttttttttttttttttttacagagtcttgctctgtcgcccaggctagagtgcagtggcgtgatctcagctcactgcaacctctgcctcctacgttcaagcaattctcctgcctcagcctcccaaggagctgggattacaggcgtgtgtcaccatgcccagctaatttttcgtattttagtagagacggggtttcgccatgttggccaggctggtctcaaactcctggcctcaggtgattcacccaccttggcctcccaaagtgctgggattacaggcgtgagccactccacccggccgcaaattttacagtcttgatcagtgtctcctaaagtgtaacttaggaaccacctgcaacagagtaacctaaagtcattctgtgtttgtaattttgcaaaaacaaaaaacaaaaaacaaaaaacaaaaacaaaaaaaaacaaaaaaaacaatgcatttgcacttataaaaaattcagaattctaggctgctttccataaataataagatgaggactgtgaatttttgtttttaacaagctttccagatgaattttatggacaccacagtttgagcaccactggatagaaaatcttgcttcacattgatatgggtcttagggcagggtgggaacattgggttcattccatttcctataattcatctttcttgataagcaaggtttcagagagacctgattgtactgctaaagtgccgtcagatggtgtcaggtgatttgaataacctcatgctctctttgcctgaattatagggctctggtgacccttggctccatattatgatcacttggagtatgtccctcaataccttctcaaaggtaatgggcatagcacaactcagagttgacttctatcagaactgaggcctgggaatatcagagtccccaggttttttagcgtcataaggcaaagtcttttcttttcttgttatagctacttggtgggtgatgaactatgggtagtcatggaatacttggctggtggctctctgactgatgtggtcacagagacctgtatggatgaaggacagatagcagctgtctgcagagaggtaagcaaatagagcatttctagctgagaagaccaccgaaattggcagttcttcatttctgattattcagaatgtttgtatcatcaaagtaacaatagtagaacttttccactgaaaacaattggagaggccaacttcaatttaaattctgtcctaatagcactccccagcatcaccctcctgagcctcttgtttattttagctgccttttgtgaatcttttagttccattatgccatttgtgaggtgccgtatctaaacccacatgctgtagtttccgtgaacatgggaaacagtgatattggcatagcacttctttctaatttggggaagtttttacatgatacttattttatcctgcatgtgtaatatgagccatgtaaaataaattatattttcatcatttttagaaggcaatttaaacaaggtcctccctcaggccagaaagcagttgctttcacagtacaatctgaacttcccttacagcccccaagtgggcctgacggtctgtctcttttccagtaagtgtcatacccctaaggggtttcaaactaaattaaagagatgttattatatttattttgttgaatattaaaaaacacacacacttttttactggagtctcatcttaggcattataatctatcccatttattgtggtgaggttttctatcaacaaaagtaggaactctgactcactgaaacttgaaaaccaatgatagaaaaacaaaactaagtgatatcagctaatctctgctttttttttataagttgttcacttaaatttcctccttccttgctctcctctcattatcattttccccaccccacatatccaccaaacatatatgttttctattcattcaatacattaaacttactaccctgagcctgtggtttccttcttccagcattacactgcaaaggcatttccaaacaagtgcctatagttacttcatagcctaggagtggttcccaaacctggctacccattagaaatagtttggggcacttgttttaaatgcagattcctgggtttcatgccagaacttctgaatcaaatcatgccatctacaatgaagcttaccacagctatagaagaccaagctgaatcctccaaataactgggccaaagtatattaattggttaatttgactgtattattgattggtgctatttatcacattatcattcttaatgtcctagtctgatgtgtcagccatcatacttagcatgataatgctaagtggcatcattgatgtaaatggtaatgtgactttaaagtggtgttgttaaagcattcagtaatcgatttcacttgacaatataaagttatatccctgcccaaaatttatctagaaataaaacttagtattaaaaattatttgtgatataattagaacttttttttctgatttaatagtgcctgcaagctttggatttcctgcactcaaaccaggtgatccatagagatataaagagtgacaatattcttctcgggatggatggctctgttaaattgagtaggtattttggttcaggtggtattagagtatcagggaatttctgttctttcattgtatatcttaagaagataatggttactgaaagtgatttatttgaaagaagttacagcccagtttgaagtaaagaatttttctaacactgtgttcctgaatattgtgaccacattttttggatttaatatttcagaatttctagtgacttgtggaatgaataaatgacaaatacctaattaggaaactgaaaaattctgtaagtttgagaaaacagtgatgagagggaattagattgaagtctagtaaaaatgacatcacgttagtcaattatttcagaccttcttaaaatcaggaccagctgagacatcagttaacaaaaaggtatgagctaggcagttgtggaaactcagtgtgtagcaaaggaaggtacagccatatctgaaagtgatatattgtaaaaggaaaataatttgggcttattttaactggcttttcttctctgcagctgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggtaagtcagaagagaagtcaggtactttattcccaggaaagaggaaaggccaaatatcatttctggcttccaccaaaagtgaccagaatgggctcttttctgagaccagtaacatagaagcaccaagttataattttcaaatttactgtaagctttttaaagtttatcttacaatgtctcaacagttttccttgtctttttctttctttctttcttttttttttttttttttggagaaagaataactaccctttttttctctttttctcatttaattcttttttccttccaactttcattttaggtgcagggggtacatacgcaggtttattatataggtaaattccatgctgttggggttggtgtacagattatttcatctcccaggtaatgaatgtagtacccaacaggtagtttttaggtcctcagactcctcccaccctccactctcaagtaggccccagtgtcaattgtccccttctttgtgtctgtgtgtactcaatgtttagctcccacttacgagtgaacatgcaacatttggttttctgtttctacattaatttgcttagaataatggcctccagctgcatccatgttgctgtaaaggacatgatttcattcttttttatgtctacataatattctatggtgtatatgttccacatttttgttatccaatccactgttgatggacatctaaattaactccatgtctttgctactgtgaatagtgctgtgatgaacatacacgtgtgtatgtctttattgaaggacaatttatattcctttgattatatatccagtaatggtattgctgagttgaatgatttatattcctttgggtatatacccagtaatgggattgctgagttaaatgatttatattcctttgggtatatactcagtaatgggattgctgaattgaatgataactctaagttctttgagaaatctccaaactgctttttacagtggctgaactaatttacattccctccagcagtctataagcattcccttttctcctgaacctcgccagcatctgttattttttgactttttttttttgagacagagtcttgctctgttgcccaggctggagtgcaatggagtgatcatgatcttggctcactgcaacctctgcccactaggttcaagtgattagtgcctcagcctcccaagtagatgggattacaggcatgcaccaccatgcctggttaattttttatatttttggtaaagaagggcttcaccatgttggccaggctggcctcaaactcctggcctcaagtgattgacttgccttggcctcccaaagtgcttggattacaggcatgagccaccaaacctagcccctttttgactttttaataataaccattctgactggtgtaagatggtattcattgtggttttgatttgcattactctaatgattaatgatgtggagcattttttcatatgcttcttgggcacatgtatgtcttcttttcagaagtgtctgttcacgtcttttgtccattttttaatggggttgtttgatttttgcttattaattgagttccttatagaggctggatattagatcttcgtcagatgcatagtttgcaaatattttctccctttctgtaggttgtctgcttacactattgatagtttcttttgctgtgcagaagctcttcagttaaatgaagttccatgtgtcaatttttgtttttgttgaaattgcttttggagtcttcatcatgaaatctttgccagggcccatgcccagaatggtatttcctaggttttcttctagggtttttatagctttaggttttacatttaagtatgtaatccatcttgagttgatttttgcatatgatgaagggaaaggatccaatttcaatcttctgcatatggctagccagttatcccagcaccatttattgaataggtagtcctttccccactgtttattattgttgactttgtcaaaaatcaggtggttgtgggtgtgtgactttatttccgggttctctcacctgtcctattcatctatgtgtctattttttttttaccagtaccatgctgttttggttactgtaggcttgtagtacagtttaaagccaggtaatatgatgcctccatctttgttgtttttgcttggtattgctttgtctattggggcttttttggttcccagtgaattttagaatagtttattctaattctgtgaaaagtgtcattggtattttgatatgaacagtattgaatctgtacattactttgggcagtatggccatgttaaaaatattgattcttcctatccaagagcatggaaagtttttccatttgtttttgtcatctccagtttctttcatcagtgttttgtaattcttgttgtagagatctttcaccttcctggttagctgtattcctaggtattttattttttagggctgttgtgaatgggattgtgctattgatttggctcttaactggacatcgttggtgtatagaaatgctactaagttttttagcattgattttgtatcctgaaactttgctgaagttgtttgttagatttagaaggctttgggcagagactatgggttttctaggtatagaatcatatcatctgggaagagagatagtttgatttcttctcttcctatttggatgccttttatttctttctcttgcctgattactctggctagaacttctaacatttttctaacatgctttgattgtatttttaatgacaagggtctttaagattccttagtatagctttctaatgtaaaatacatgtagctttttttttaagtgagatgtggggagaaagtacttttattacatgacatggttaaatgatcaatctaaaaaacacttgctttataattactttaacaaagtaaataaatgcatttccagaacagctgtaatttttaaattggattttccttcattatcagtaatgatttattgattaacaacagcttggtgggtattgagtggaacacagagatagacatagtgccaacctggtgaaatcagaaacttaattagattgtcaagtagaaaatgattggaaacagtttccgtttggtaactcactttgctaccacaaaatcagagatttgatcttcatgtgatcttgttatccctgcaaagagaaaaacttcatttcacaacctaatcctatcatcttatttcggagatgtgctgttgatcatgaggaggaaaggaaagaggtatgaaagaaatgcttactcagtgcagaagtgagccataggtattttgttgtgtatagcccaacagtgagctattaatagaagctgtgttttgtgtctataacaggcatcacattgtttaaaaaagaaaatatgcacagattcaaattctactctcaaagttcaagcacagtgctagtatcataggcatcttgtatactgcctgcatcattaccactaggagtctaaaattgaattgtacccttggtatgccaaaaaaaaaaaccattgttcttagtaaatggttaagtgttttcatataaagcttgcaaaatccatgttcaaaccaaatatatgtggctttctatgcatgtaaagagacctataaactaactgtctagttgttttgcagttaaacattttgtatttgggaactgcattccctgtatatggagaggaggacagcttcctcctggctctctcctaactcctctctggtacttggcctcttgttttattccctgtgctgattagaaaacaacagatatgagggaatgccctaatgaatgctataggctatttctctgatctcatgcaacaatctggaaatgagatgtgcacattgattagctgccttcagggctgagtggaaaagaaggggcattttcccaccgtttgtgggttagccctccatggatttaatcaagtccacacctggcctatggtccagcgcatcaggataattacatgggcttttccttattgtttaaccaccttcacccattaagaaatagcagtgaaagaacacatcggacctcttgtttctatggatttcctcccctaagtctttggagtttggaggcactaaatggattatggctattttgctttctgccttctaatgagtaatttacagcctgcaaattttaaggattaaacaaatggctctgtaaaacaactagtctcagtaatggatttattaccttcttcaattccccaattacaattgatctctctttagctaggctgctaattattagaaaaaggaaacaagttttaatctttataggcatcttctagcctaggattagaactcacaattaacagcttgtatcttagatgccaccgcctgatatctaaacaagtacttgcagattaacaaaccacaaggttcaggaagcctacattaagtctgcaacaaaaagacctgtgagaaagaccaccctgttgaattccactgataaggatttactctaactttgctcattactctctgtatgtgtgatcaaccttcaattaatcaatcaacaagcccatacagagctagctttattctaattttgtctcttctaggcatcaggagtacttttttggtttcgatttcaaatatgttttcctaatgttctcttgaaggaaacacaatgtctcaggctatatgcccttatttggaatctttaaaatgtagtcgctgaaaccatggggagattggagagaaaaaggatctaacatgagcctatagggagcagcgatttcttggatcctggtgcccaggccatatgtggggaaatagaaaataatccagagctttaagaggagtataaaagagtgccagattagtcttctttaatatccttccaacactacaacacatccactattgtgtgctttgaggtggaaagaggtagaaggaaggaagtgaaataagtgtaagaaagacagagtagtagagtacagggtagcatgttgatgtgaaaaattttggtcctgtagtcaggcagatctgggtgtgtcctggctctacaacctgcaagctctgtgaccttctgcaagttacttaaaacctttctaagcctgcttcctatctgtaaaatgagaactatgtctatcttacagagttagcatgaaaactaaatgaataatatatgtaaatcacctagcacagtgtccagttcactgtaggaaaaaaatatatatgtatatatttatatatatgaaatgtatatatggatagtaaagtagtaagataggaaaaacagagaaaggatgtttagagggttttttttacccactcatgaagggaggttggattcagcactctcctaagaacatatccttcatgagagtggcacacccatctactcaaggaatggagggttttgcacagttcagtacaattaccatgaacaggtaacactgaacagaagaagttcaaggtgaagtctggggctatacatttcaaggtcatttatgtttcactgtgagtttttctgtgtctctgttgtatcagttccagctgagcagaccctttatgaatattgcctattaacatattgttaatgcaatgaattaactacttttccccttagttagaaagtggctgagattttttaatgtaaatgttgctatactaattgacctaatttgttcataaaatgccttttaaaggtcagagagttattaattgtactgatgttatgaggcttgtacccttccagagagagaggacacaagcttcttactgtcccccactgcctgaagtctttgtactcaacataattggccttggacatgttgttctgtgacctatagacagttttagtgcagcctccaataattaagtaccttgttccttctctttgccaaagtgactggggttaaaaatctaactttccctgtggatatacaaatcaaatgttactgttgctgatatcatcaacttttttgttaattgaagactttaaacaactgttattataataacttgatgctaagtaaggagacacaatcatttttgtcaaacaaaactttggtctattttctcagcacccagagagtgcccctttattaactttgcttttacacgtaatggggctattcttatcaacaggttttgatggaatttgttatttgtgaaatgtaaaaaaatgacatccacttgaagtccctactagactctttgaaacaccttttatggtaatgttccaaatctttatccaagttaaaatagattttaagtgttctctttctaccccttacttgaaacatctgtgaagctgtatcgaagattggatcgctggaagacagttattggtatcactgctaaaaacaatatgtagtatagtatgtgaaccacagatcctgtatcagtggatctccttggttgcacattggagtcatctgtggagctttaagaaccagcgattctaggcccccatcctcagggaaaaatggcaatcaggaaatgtcaaatatcaatgtggcaagccctttatagaacactgtccagcctggacaacaattcgtcatcacccctctttgaacatggtcgtccaaccaaaaaataacactatcattctactcacatttatccattttgtctaaaaacttatgagtaatactataaaagcctaattgaagtcctgatgtgctttatgtcattctctgatttaccagttgagtagcactatccaaaaagaaatgacattagttcagcatatgcctccatgatatgctattttcttttgcaattttgcttcttctgaaaatggagttcatcattaaaatgggctagctgctgaccgagtagctagcatatattggtgcataataaacccatcagtctgactactcatgattaggagtgcattacctatatggcaagggggaaaggaggacagaaatctaaaatcagacctcttatctacactagtaggcttcccacttcccttttcctgcacttaaagcactacagaaatgttagttgttcttatttcttcttgtgggaacagggaaattataattggcttatatggctagagaagagagttaagcagaataagagaatctctagtaactgaaaagcaactaaaggctaaactgtttctaaatccctccaagcactgggactttgctgtggattggaatgtctgggtttgatggcgtgtgctcatttggaattaaagtcagacataaacttcctgagtgccagagaagcaagcatactttgctagcactcagtcaatattgttttgaatgtatttcaggaagagctgggagcattcccttcattttccataagccatgatggaacagcaaggtttattgatggtttgttgacactcctcctattttgagggcaaacctatgcctaaaaggagggggaagttgggatcactacaactaaaataattacagaagaataacagggttcctttttaatcagaaaaaaatattgcctgtcaaaagatagacagctcttaagaatcattggttgttaggaattcagcataggaaaatgggacttagccataggaaagctgcaagtctcatttagaatgtaattcagaagcagacagctcaaactggtgaattatgacccagaaaacagccaaaggagaaattgattccatagcaaactaaaatccaccaagagaaaatgagagaaagaaagtttatgctactattatgttataatttctcagaatccttatagcatggcttgggagtaaaacaaggatgcatatgctgattgccctaataggtaccatacctataactaagtagttaagtccctccagatcaaagttaattctaaagagacaaatcatggagtgtgatgatcggcatttgcgcactgaaatgcccatgcacgtgttttatcctatggcttttgaaatctgtgtttttgccaatgaagaattattttaccaagaaagttggagttttcttaataattaagataatttctgacctttattgtcattttgattgataccttttccaaccgggttgcaacatcattgtagaaaaccctttgcattctaataaaacagtactctgaagtgtcttagataagacgctctgcagagaaagttaaatcaattaaggcagtgtaagaattgtagctgggagagtcagagttctaacattatcccaataatcaaactgacctttctgttgtagcttttttctttcttttcttttgctttatttttcttttcttctttcctttgctttgttttttttttttttttttgtaaagaattaccctcacgctcagatggcaaagttcatcagcacattttttttttttttttttttttaatctaggaggggccaatgactgtgagagatctagacaaggaactttctagtgtctctaccaactgttcgcattatgcgggttaaagagtgaattgtattccgatgtctgtcagtcaagaaatccataaccttgtgcaggtttcttcttgctgagcctacatttccttattgcttcaaaagagtggaatttcactagatttttgtttaccagtaggctccacaatgccctagaataccatagagttccttgagggtattgaaggagccaagagggaggtaaccaggatagggctcttggttccaccagaatagttcctttttaattccttttctgtcttgcgccatcacatgagattttcttaaataaggctaaaaactcgtgagtcccttactctgattctgtgtcctttagctgtacacagcctacagccttccccaactctgccaaaagggccatgttttgtgtgttgtctctatgagtctctatgagtactttcagaggagtggtattcagaaagcagcttggagacatttatctcatcatctctggagtaaatctgtatcccacagaatggaaaaatcctccttttcccaccaagcaaagacacttgatcatgatgtgaaatatactgtatatgagacttggtaacttcattctgataataatcttgggaagaagccagtgaagaacactgcagtaataaagctattgcagggacacaaggttcctcactctgtagtagtattaaaagaattgtatattattatgtacgggcctgttcagctgattaactgcatataaaaatagaagttgaaatcagtttatgtgactagtaatgcatgtttcacagatcatatcacagtcagcctgttttaatcctaatatggtaatttggaaaagcccaaaagaataagagtgctagtcccttcttgcactaatattctgaaatgaaacatgaacaaatgtataatattaaatattaccttaggactagaaatttgttgtgtgttaaagagaaaatgggaggtgaggaagttgataaaccaagtatacacagtattttgagaagttttgtgggaaaaggaccaggagcaatggagcagtcacagaatgggacctaggatccaggtccccttggtctcccagattgtctagcccttatctatcttcatttctctttgtcctcattccaccagcgatattctcctcccattgtcttttggcccctgtttttgccctaaagttttgttttgcttcctctgcttctcacagcttcttgcctctaccttttgcaccattttgctttccttcctttcctagctctgtacctacccacatccctacttccaaatgccctatagttccaaaccttgggtactgctttgagtgcccagggttgcttcataagcacaagcagccccctctgcaattcttagcaagcattattagttctgagaatgagcacacatattgttggagttatctgtaatttattttatggcattggtcagtcctttgtgcttgaaaggagcacatttaagctaggctaacagccagtgagtcagccctacctaattaccttttactatcaacctataaggggatagatctataataggttcattttaaatagccttttaaggattaaacaacaaaacaataacaattgtccctcataatttagtgaccagtgagaacttctatgtaagacaggtaggaagctaaattagaccacattgctcattcagctatcacactgaagttttgggttgagtaagcccaagtatggaatacagcgttcattataatgtgattatttctttttgtatatttggccctcattactctcttctaaaaaagacatggcagacactttcatgatatccataaacacatcagaggcagcaatatactctggcttttaaactgtgaaatcccaggtcacgagtaaactaagtcataaggtgttaagtcacttgttggcaaatatctctcataaaacactcaaagttagttggagattctaaaacaacaaaagaatcagattaggagtcagttgcaggcaacaaccagctgcatataaaccttcaatgtagatagatatatacgtgtgtgtgtgtgtgtgtgtgtgtgtatatatatatacatatatacatatacatatatgtatgtgtgtatatatacatatacatatttacatatatatgtgtgtatatatatacgtatatgtgtgtatatatatacacatatacatatacatatacacatacacacacatacatatatatacacacacacacagttgagcctctgatccacgggtgtgaaatccatggattcaaccaaccacaaatcaaaagcattttttaaaatgatggtttcattgtattaaacatgtacagactttttcttgtagttattcccaaaacaataaagtatgacaactacagtcatgtgctgcataacaatgttttggttaatgatggactgaatatacagtggtggtcccataagattataatggagctgaaaaatttctatcacctagtgatgtcataatatcctaattcaatgcattacttacatgtttgtagtgatgatggtataaacaaacctacttctcaagaagagcttcaggcaggtccttcaggaagtatttgcaagcaaggtattgttatcctaggaggtgacagcgccatacaagttattgcccctaaagtccttccagttggacaagatatagagaggggacaacagtggtattgatgatcctgacgctgtctaggcctaggctaatgtgtttgtttgtttcttagtttttggggaggttttgttttgttttgttttgagacagagtctcactttgttacccaggctggagtgcagttgtgctgtcttggctcactgcaacctccaacccccaggttcaagcaattctcatgtcccagcctccctagtagctgagattgcaggtgcctgccaccacactcagctaatttttgtatttgtagtagagacgaggtttcgccctgtggcccaggctggtctcgaactcctgacctcaggtgatccgcccgcctcggctcccaaagtgctggggttacaggcgtgagccaccacgcccagcctgtttgtgtcttagtttttaacaaaaaagtttgaaatgaaaaaaggaaaacatttttaagatagaaaatgtttatagtttataggataaggatatttaaaaaatatttttgtacagctgtacaatgtgttttaaactgttacaaaggagtcaaaaagttgaaaaaataagtttataaatttaaaaacttacagcaagctaatttattatcgaagaaagacaatttttaaataaatttagtgtagcctaagtgtacagtatttataaagcctatggcagtgtatagtaatgtcctaggctttcacattcactcactagtcactcagtgaccctgagcaacttctagtgctgcaagctccattcatagtgagtgccctacacaggtgtaccatgttttatcttttataccatatttttactgtactttttctatttttagatacacaaagacttaaacacactgcactagtcacctacagtattcaatacagtcacatgctgtacagatttatagcctaggagcaataggctgtaccatatagcctaggtgtgtagtaggctattcaatctaggtttgtgtaagtgcactctatgatgttcacaaaacgatgaaattgcctaatgatgcatttctcagaatgtattccccatcattaagcaatgcatggctgtatttacatggcatttacattgtattaggtaggtatcataaacaatccagagatgatttaaagtataggggaggctgtgcataggttttatatgaggaacttgagcatccatagatgttggtatctaaaggggttcctggaaccaatcccccatagataccgaggaatgacgtgtgtgtgtgtgtgtgtgtgtgtactagacagtgggcaatatacaatactgtatgaaacccctctacctctctgagtgggtacctgccctttgttccccatttccaaacaggtagagaatgattgacctcaagaggacccatttcttctgtacaggcagaggtggatcaattaaaccagtagcttatacacagtgtgcttcactccttgaaaagcccttgtctgccttttctaggagcactcccataacagagactgggaacagtgagacgtggtattgtgcagtggtcaagagcatgaactctggattcatactccctggattcaaatactagttgtgtgacattgggcaagttcttcttatctccacaagcctcagtttcttctcaattggagatcaaaatagaacttattataaacagtctaaaataaatttcaagggtttatatgtaaattgcacaagctaatagtatcattcagtaaaagttatctattaatactttccatggatataacatttatatagatatcaaggtatcaatgaatagccctcttatagttcagttgcattgtatgttaagtcgacttttagggctgggctggagccctgtcaccatgtatcatatgatttccatggtaaaatgtgttttgcatctcaaatattcagcctacaaagaaatgtttgtactgcaccctatcctctttgtaaagtgagtctttatattggtgctggggcccctcatggttgctaacacgtttccatgtaagtcctctggtttgttttctaatttcttaacttaaactttataaactgttgtaatgaactgaagtcacaaactaaagctttttaattaagtggttagtcctgttgcaaaactgccttaataacaatttattgagtacatatggattgtgtggggacttctttggagaaatgtggtaacttctatgatgactgctttgatcttttttaactgaggaaattgttaatatagtaaattgaattatcccttaaacttggtaacctagttttctcttagtacttaggtaaattcagttgcacatcagtgtcagtggaaactttgatgtttgtgtgttattaccaagatatttagagttattatgaagaattcgagaacatcagaaacttctaggtaatgcttatatcacaaggaagaaagccaccgtttttctggccaaaggttgtatttctaacattataaataaggtccgtaggttatggggcctatattgcctcacctcaggaagaaagcagatcttgttaaatgatctaatagattaatcaagagtaccttttctgttcaagaacagccagagagaataagtttctgaactatgtttcaagttccagagaacactttttttcttccctttctctatgggtctttctgcattggccatgttttagtcatctttttccagttttccctccctttggtgatgacatccccttacatacactattcatacagctctcttccttctcccacactgaacagtggggtcatcagaagttattacatgccaggcctgttcagctcagaaaaggtgctatttttcattttctgcatatcttcttagattttaataggtcacttttaggttctgagctttaatacttatgtatataagtctgttatagtctcagctcagttaaatttaaacattttggctattttgtccagcaacaaaaacatttattgatcacctattttgagcaagttgtcacaaaatccacagttggttataacacagctgctaccttccatgggctcacaatctaggaaggaagacagacctgtaaacaaataacaagtgttcatatataatacaatgtaaaaatagacatataaaccaagaactctcagagttcaaagaaggaaatggctaattccatctgcagggtgaccatagaactatcctggtttgcttgagattgagggacacaaaaccttcaatactaaaacccaggatagtccccagaaaaccagagtggttggtcaccatgtttacctatctaggagagatggagaagacttcaaagaggagatggcattttaaccagtgcttgaaaagcaagtttaccaggcacttaaggcaaatgaggatagcattttaggcagcaatgaaaggcatttcctattcagggaatgatgaacaaattggtgtgagtagtatgtgagcttcagccagtgtgtatgtgtgtggcggggcgggagaggagttgggagaagggccctagggtgagaagagaacagatggaaactggaactggaaaggtgggcagggggcaaatcatacaggactgcctaaggaatctttactatgtcctgtgaatcagtagttttcaaacaactataatgatcctctggttccagtgaaaccttgcttggaagcacaaataaatggagaaaaatgcacaaattttctgattgaaaaaggtatgtgggctggacgcggtggctcatgacctgcactttgggttgctgaggcaggtggatcatgaggtcaggagatcaagaccatcctggtcaacatggtgaaaccctgtctctactaaaaatgcaaaaattagctgggcatggtggtgggcgcctgtaatcccagctactcgggaggctgaggcaggagaattgcttgaacccaggaggtggagattgtagtgagccatgatcgcaccactacactccagtctggcaacagagcaagactttgtctcaaaaaaaaaaaaaaaaagaaagaaaatgtatgtgttggggagagtcttagagtatctcctcctctttctccctgttcttttccctcttaactgctcttaagaggaattttggggagcacagtttgaaaaccacctctgtggaccatggggagtgacaaaaaattttaaagcaggaagtgaatgacatgatgagacctgtgatgagataagattgttaaggaggatggactgaagaataaaaaagcttgaataatggaaaaacggttaggaggttattgtaactttggaaccatctgaaagaagcccgactttaagcaaagacaacagggatagagagaagtggatgggtatgaaagacatttctaaaggttgcattaatagaacctggtggactatttataataagggtgtggagcggggaagattgctgggtgaggaagaagggggaaaagatgattatatggtttcttacttaacattagaagcaaccaactagtatatgggaaatctgtagtctaatttctaatagccaccttattttctttgagttttcattagctcagataaaaccaacatgttatcactcacacccagaactattgtccttaatctttcttcatctaatacttgactttgctagtaaaaccctttttgttgtcattgttttattggctacaactgtatttgtctctcattagctgggtagtgggtagcaattttcttttttttactaagagagtccccagcttactcacaggatgtgttccaaaagtacatttttaagttaattatttggacctcagagtacattttcccatagaagtggcattatacatagtgattaggttcccaggccagtccacaaaagccagtttagcccatatataactgaaagtgtggatttttgcaatggaaattagttgtaaatgatactgttgcaattaaaatgaaaacaatagttgcaaaagaaatagtctgggtttttgtttccctcaaagagtagggcttgatgaaaagcaggtttaatcctaggaagacaaagagaaatagatggggatttttgtgtaaattggacactgcagctttttaactgtattttctaactaatgttttggaggttttaaaataataaaagcaactgtgtccattgtagaaaatttgagaaattaaagaatacatttcaaaaattaagtcaccaacaatcctaccatccagagagaaccagtattcacaaattggtgtgtttcagcctttttcttaccgcatgcattttttaatcagttcaccaatagtaattatggtgcatcgacatgatgaactattatgcagctcttaaaatgatatttatgaagaatttttaaaacatccaaaaatatttatgacatagtgttgagcaaaaggcaaccttgcatttgataccttgtttatggatgagggagtataagcagatcaacactaatcaaccagggcaggagtctgctgttaggccaccagtcagaacctcctactatcagacccaccccctaacaaaaactacagccagacctttttgttgaagttctgaggaggacataagggttctttgaagtactgtagaggttcgtagcactggctcttcattacttcagattttccttcaaattacagggctttcttctcccttgatgtactatttcactagcactactcaggcttaacaactgtgattaaggtcatttttttggattcataaatggaatggaaaaaaggccaagtatttccttaggtaattatgcatagattggagagagatgagaaggactcaggtagagaagatgtgtatgtactttcaaggaagaaaattatgtggaatagaatatattaagctaagaatggtgaaagtaaagtgagaaaatgagacattatagcatgaatacagatctacagagagcggaaacgagtctgggaaaggaagaaagaggtgtgcttgtttaggtctgggcttggctacagagcaggaaaaaaaggaagaacagtgactttggggaagttgtagccagctgaaatcaaagttttaggaggaggcagcgaatgcaatttgtagcaactgattttgttttaataaaggaataaagatgtttgggaggacaggtgcttcaagtactaatcatccaagaagaaaagcagtttgaacttaattgactatatctgctatgattgtgcactattcgattttagcccaatcagtgattttctaaaagcatcccatctccttttagtcaaaactggatttgtcactgacttgtatgttggcatggaggtcctaatagctgccacctgcatttcctgttcatcaatgaaggtattgaaaattacaaaggaatgagagttgggggaaaggaagatgttcatttcgtaggggtgagggatgtatttacatgtgggtttttaagtgtacagtactagaaggaaaagccaaaagtttccatgcattctagagaagcatatggcattgtaattctcacacattgctatgcaagacaatctcctatggaattctgtggctcttacctttggtgtacatacgacgcagagattctgagttattatgtgtgaattgggctccaggttctcagccagggattctcattgttggttgtaaattggaatcacctggagagcttaaaaatattggcacctaggttctgttcccagaggtttttacttaatttttctgggggtgagaactgagcatggggattttctaactctccccaagtgattctaatgttcagacaagtctgggactctctagtttagcccattgcttaattacttgggtggattaaactagttgttcttaaagtgttgtcctggaaccagcagcttcaacatcaacaggacacttattagaatgcaaattcttgggcccctgcccatatttactgaaactcttggggtggctcagaaacctgtgttttaacaaaccctctggatgattctgatgcatgctataaagttgacagccactagattaaacggttgttcctgaccctttctaaagtacatctgtgggagttgctaaaaacaagagatgtcttcaagagctgatgaaaactggcctgcaaaaggacttttacagaaatacctataataataataatagaagctagagtagagaaaggggaaaggggatgataatttgctgcaaaacctgggcaagttcagggggaacatgtcttcatgagttagggagtttgttgcatgggctagtaataccctggcagtacctgcaggcaaactcctacttattcttcaatacccttttaaaatgtcagcctcctctgtgaagctttctctgagctgtggtgtaaactacttcatccttgtgtttacttagtgctttctagtttcctcgattagctcttggcccactgtactgtagctctctatatatgtctgtctcccactaaactgcgtgatccttcaaagcaagaacactgtcttattcatccttagctctccagtgtctaataaactatctggtacatactaaatgctcttgaattgtttgcttagaggggggatcagtaatggccagctttcttgtatcaagaaccttcagctgggcgcagtggctcacacctgtaatcccagcactttgggagaccgaggtgggtggatcatttaagttcgggagttcaagaccagcctggccaacatgctgaaaccccatctctactaacatggtgacgcgtgcctgtaatcccagctactctggaggctgaggcgggagaatcacttgaacccaggaaggcggaggttgcagtgaactgagatcgtgccccgcactccagcctgggcaacagagcaagattccgtctcaaaaaaaaaaccttcaaaagatgggtttacctttgtgaattaatcgtagtcctgagttcaactctgactagaagactagagacattgattctctcaggccatcatgacttgatatctcttagtggtggccttataccacaaagctctcagagaaatatacaattattagcaacttattattttaccatgataattggcaggtgccaagactactattgtcattttttcctcatatttcctctcattgtagatgcaccttcatgggaaatctaattaaaatcaatagggatacagctgccacagggtaaaagtatttgagttcttgggccccacagcttgcctctctcatccaggcactggcatcttctggttcattgtacttccctaattctataatgtactctcttcattccacatctattcacaaacattcttcaaacaagataagcacttagcaaattacaattacctttccattgcactttcccaaggttatactcaggtcaaaatgaatggatgtatgtgtattccccaagtctttagagaaacagatttacaggcaatcctttggtttaattttctagatacttaatcacatattcgttatatgtgggtttttactggcttaactctcagaggacaaccatataaccttatttttaagtttttggaggtaggacgacacttcactgtcacctcagttactgccaatattaatcatttctaaatgttatagaaactttgaaatatatgtgtcattctctaaagtggaattattaagacccagaatgtaaaccagaagaaactggatttttgccgtctgtgccaagccatgattttaatatgtatgtgctgaatggatttttctatttttttctacaggcattgtatctgatagccactaatggaactccagagctccagaatcctgagagactgtcagctgtattccgtgactttttaaatcgctgtcttgagatggatgtggataggcgaggatctgccaaggagcttttgcaggtgaaaataaaataggacaattacaaagagaggcattatactcagcttttccatctcaatgtgtgacagagagctctgtcaagagatgtctagagttaggctattaccattttattttagaccacaggcacataactataggcacgcatctaatacatgattgattgacgtgttgcctttcttctgagaagttggcagtgtaatctgtaaatctcttttgttcttcctggagtcttattttgcaaggaaaaaaaaaaaagcaatgtgaccctctggtgttggtgttttgttctaaactttacttgtgcccctggatgttgtatgcaggtgctcttggccggaggtaattctctacataactatgcaattatttccatggcatttgctactctaatgctttgctggtcaaagcccctttgcttgtgatgccaattggcaggcacctgcttgcctgggtgagtaccatccagtggtgagtgcctctgtaaccatttgtccttttcacggctcccagggattagtatacatgatgagaaataatacttactatgtaccaaattctttcaataaattatttcatttttataacaactttatagggtaggcattattatcccattttatagatgtaaaagttgagactcacagctcttgaagggcagagctgggatatgagccctgaattgtctgactttccaccacacgtcacacacaaaccaatttagataaaaatatgtctgtatttgataaagcagtacgtgcccaggattatacacatagcttcactgctggggagtgtttctcagggacatgtatgaagacatttaacatctaagaacaatgactgctatttttctttgtgattttgaacacataagccaattaaacagaaggtgcaacacttggttatacagcgcattaaccacagattgtctgttctagcctactccctgaaagaaaaacctgttcctgttgcttctgaactccttccagagacagagctgcacccaggcaaaaactatcccaccctaactcagatcatacctggaataaacctatttggagaaactgaagagactacatcttttcttttctgctacctgcaagcatttcacaggttatcatagggccctaaaatgtcaaatctggaatggccctttgttaatcctctaattaatccagcctcaaattacagatgaaaagacaacttttgagtacatcacttttatattttttcacccctcccaccactccacatacacattctgatacacattcctcttatatcttcttgtaaggataattgaaggtgtaggttatcttcaattggctatccagataaatgtggctatccagctaaatagatcattaaatcaattatctagttaattcattccccaacaatacttttatatgaaccagtcagataactgatacaaaattgtattttgagtctaaattgaatagtttattgcgtcttttcattttatatatgtaagcaatagcctgtgtttctctttgagtccatgcaactccattctctgactctagcctattattgccattttcaagattagaaaggggagagatgcatgacattcaccccactggaaggctggagaaaagacacaggtcttcaatatttgtgtgtctttctgtatgacctaagacagttctgtccatcaattgatatttattgagcaacttccatttgtaaagcataagtgcagtgggtgatacaaacctattaaaaggcatgattcctccatttaagaagttcacaaccttcttaggtacatgaaaatataatgcaaagctgtttacagactcattcaacccaaagagctgttcaaatagtaaatgatatggttgattagagaaatacttctgttagctaggggtgatcagaaaatgtcttcaaacaggaaagaggtcttctgggccttaaagaagtgatcaggtttagttaagttgaagaaaataagggaagggatttcaaatggaaggaagtgttagggtataaccaaagacatatgggcaaggtctacaggaacagaacctagaaagtgtagctgaaataaagagttcaagtaaagaagctgcaggggataatcctatggtgggccttgaacaccaggcttaagagttggggctgtaggcagtggggaaacactgaagatgtctgagggacaagcatgatgacaactttgtttatgaagattaatctggtagtatgtggtaagaattagcaacaggaaaaaatggagacagggagaccaagggggagttattataatttgggattaagatgattaggattgaattagaaaaagcaagagatggccagacgtgattgctatgattgctatgcctgtaatcccaacactttgtgaggccgaggcaggcggatcacctgaggtcaggtgtttgagaccagcctggccaacatggtgaaatgctgcctctactaaaaatacaaaaattagccaggcatggtggcatgcgcctgtgatcctagctactcaggagactgaggcaagagaatcacttgaacctgggaggcggaagttgcagtgagctgagattgtgccactgcactccagcctgggcaacagagcaagagtccatctcaaataataataataataataataataataataataataataataataagcaagagataaatgtaagagacgttgagaagagagtacccggtagcttattgcatttagaacataaagaagaggaagacaaaagtgacttcaggctatcaagtcaatggtagcattcagcaagaggacaagtgatggaagacaatataatagctaacatttcttgaccctatgtaacttacaagggattgccacttacctcatttaaccattttaataaacagagatgaggatttaacctaagtgctctgactccaaagcccctgtagcttacattacacaagattgccctgcttgtgagactgtaacataactttttaaatgttgaatttaaggtgacagaagaaaatcccgtaggaaatatccagcaggaaaactaggaccagagttcaggaaagagatcaggtcatacactatggatttaggagtcatctccataaagctgatggtgggttgaaaccatgaaagagaatgacatctgtaagaaattaaattaaaaaaagaagatgatgacagccaagttcttatgagtgggaggtaggaggaggaagtgaaaccagggaagaaaatggagctggaatattcagtgcacatgcgcatggaagagacccaatatggtagaatgtcacaggcttctgaggcaaaaaaaataaattaaaaaaattcaaagaaggaagggatattcacttttattaagtactgcagaggggccaaaagagaaatggtagaggcacagccgttgggtttagcagttagtaagccattggtttcaggacagagttctctagtggttaactaaatatactttttccaagcatgacagcttctctagataaatatatcagtttaggaaaatcagagagtcagactgttgcaaacacagtgaggttttacaagatccctcagagtttctcactctgctagtcagcttccagaggatttcatgacaatgaagtacaaaaacatctgaaggacaaaagctggcaccgtttttaattaaatgatatttaattgggtgttcaaaatatatcttaattcaaaagggctgcttgaaaatgtaaagtaatatacttgttggaggaaagaattccaataattcctctttttccttccttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttct

SEQ ID NO: 203 - DNA, 4638 bp, Homo sapiens
atgcccatgtctactattttgccagtgactagtccatgtcttcctgcaacaggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgtgagttacctgctgagcccaaccattttctctttttttctttttttttcttttttttttttttttgagacagagtctcacaattgtcacccaggctggagtgcaatggtgcaatcaatcttggctcactacaacctccgcctctcgggttcaagagattctcctgcttcagcctccggagtagctgggattacaggcgcccgccacacctggataactgttacacttttagtagagatggggtttcaccatgttggccaggctggtctcaaactcctgacctcaggtgatccgcctgcctcagcttcccaaagtgctgggattacaggtgtgagccatcatgctcggcctgactgcagccattttctgacttccctctgtactcctcttatggctctattccttttttttttatggagtctcgctctgttgcccatactggagtgcagtagcgtgaccttggctcaccgtgacctccacgttccaggtttaagttcttctgtctcagcctcccagatagctgggactttaggcgtgcaccaccacgcccagctaatttttttttgtctttttagtagagatggggtttcactatgttggccaggctggtctcaaagtcccgacctcaggtgatccacccgccttggcctcccaaagtgctgggattataggtgtgagccaccgcgcccggccatggaatgtattctcttttatgtctctacctcctacatcttatctccaggttggatgattgatgagaacattcgcccaacctttaaagaactagccaatgagttcaccaggatggcccgagacccaccacggtatctggtcataaaggtgagtagggagtaggaggtgctaaggaaatttagaaaaaggaggagttggctggaaccaggattccccctaacaatcacctatcgatatagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtggggtaagacaacttctaattacccaacactttgcaccctgagccctcacaaaccctacagatacccagattaactactcaaaggcccccatggtgaatgtagatttctcccttcatcttaaccttttccttattttttcatcctagagccagagccttttaagtccatcatctggatacatgcccatgaaccagggtaatcttggggagtcttgccaggtaagttctgttgctgagaggctgggttttaggatcagattgatacgagtagtatggaagacattagaaacctctgaggtttaatcagtgtcctgcaaaaaagaaggcagtgagggccgggcgagttggctcacacctgtaatcccagcactttgggaggccagagagagtggatcacctgaggttaggagtttgagaccagcctggccaacatggtgaaaccccgtctctacccaaaatacaaaaattagctgggtgtggtggtgcacacctgtaatcacagctactcaggaggctgagacaggagaatcgcttgaacccgggaggcagaggttgcagtgagctgagattgtaccactgcactccagcctgggtgacagagcaagaccctgtctcttaaaaaaaaaaaaaaaaggccaggtgcggtggctcacgcctgtaatcctagcactttgggaggccgaggtgggcggatcatgaggtcaggagttcgagaccagcctgaccaacatggcaaaaccctgtctgtactaaaaatacaaaaactagctgcacatgatggcaggtgcctgtaatcccagctactcgggaggctgaggcaggagaatcacttgaacagggaagcagaggctgcagtgagccaagataatgccactgcactccagcctgggcgacaagaacaagactccacctcaaaaaaaaaaaaaaaaaaaaaaaaaggcagtgaacaacccaatatccttctaaacaaatctctcttctttcctcatcatgtaaatttccttgcattattttctgtttattttcttccttaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtgcctgactcttcctagggctttcctcaatttttcctcgaattctttccccgggctcctcttttttcttctctgatcatatgcctctctgtcctattaattttttcaaactttcccctaccctcatgaagttcttcacatacctagcctttcttctcaacccccaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatcca

SEQ ID NO: 204 - DNA, 38461 bp, Homo sapiens
ctccctcctagagcctggttgcagccacttgtgcgatcccggaccttgccgcggccgcctggctcctttccgcgccatgagccgcaggttcacggtcacctcgctgccccccgcagggcccgccagaagccctgacccagagtcccgccggcattcggtcgcagacccccgccacctcccgggggaagacgtcaaaggtagaggccgcagggggcggggcctgccagggccgggcgggacgagggggaggggccggggcggaccgtctgttgaagggggcagggccaagaccgggggcggggaggggtcccagccctaggcctgagaggggaatggagccaggactaggaaaccaaggggccggggccgcggaacgcaaagtgtggagggggaggggccaaacgcgaggtgggcgtggccacgagggaaaggggtggggccagggaaggggtttggacggaggcgaagggggcgggtctggtgatggaaaggccggggtcaaggtggagagtaggccgtagggcactaaaggggcggggacatctcgagtagggagcgggaccagagtgaggaggtggaactagggaaaaagggggctgtgtgttgaagggggatggtcaggagcccctaaaggggaggcggcgggactaggttggtttggggtcaggaaagggcgggactagtagggaatgagttgggccaggaggatgggagtggggcctgggaggggggtggggtcgagggcgggaggaaaactgagtcagggttgccgaggcaggtgccaggtcagcgggtcctcggtgcctggcggatcctccaatcctctagctccctggaggcttagcggacagcgactggggatcccgggaaggagacgggaggcagggaagttagtatggatcctgggcagcgagattcagggaggatgccgtagggtcgctgatcccgactcttggggacccacttagctccttgtctgctcgagctccgtaagggttgggaggagccagctcaggcggggttgggggcgtcttcctcgcgggccctgtgcagggtcttgtaatggaagttacacgcagggcacagagtataggggaggggaaagatccttctggccttcggtggagaagtagcatcctgggcgcgtgcacagtctcccctcagggggcactcatcaggggtcctctccctggctctgaggccctcgggtctggaaggaacaaggcgaatcggcttgtagtggccccagcgaggggaggaggaggaggaggaggaggaggaggaggaagaggaggaggaggaagaggaggaggaagaggaggaggaggagaaggaggaggagaagcctccccagaccgccaggggtcgctgccgagccgcaggtgagctcgccccgaagcaaacccaagcgccgaaacccctagagtaacccttagggggttatctggcggacctcctcattgtacagatgaccaaattgaggcctggaattccgaatggccccagtcccgggaaccgaacgcctcctggttgtggccacttggatttcttgggctccttccactcttcatctttctcataatctcttttctcattttcatgaatgaccttaccagcctcccagatttgaaagtaagaaattctggagccattctcaacccttccttttttctttccagcaaatccaactgatccccacgtcttggccattcacctctgaaacttatcctgaatctggcagcatcggtcccccctctgtcatcatcgccctgctccaagcctcacatggccacgaccacatcctctccactggcctccctgcctccagtccttccctagccctcctccacagaagccccccatcacttgcaaaataaaggccaaagccttaagtctgtcattctctttcctcatttgcttctggtgttcttgtccacattcattctcccacctccatcagccaggaaaactcctattcgttctgtaagttatagctcatttaaccttttccaaaaaccttttcagtttcctcttcggcccacccactgcacccttagtgcacatgtcccggtggatggcagtcgttttctttacttatgggtatcctccattggaacatctcaaggacagggaccatctcctttatctttgtgttctgagttccagacccagagcctggcacttagtaggtgtgtaatgctcataagatgagaggagggtggctgtgggatcctgcttctctacccttgccttctcttctctcgctcctcatcccctggcttaggaataagacggccctctctcatgtcccaaggtgattgctgttttcccattcacactctcagatgccggtactcacactacttcgctggggtcgaagtgaaacacagcccccaagctttgggtgtgcaggtgtgtatgagcctggaatgctgtgtgctgtggcagaggctgtgtgtgtgtgtgtgtgtgtgtgtgtgtcttgtgggaggagcatcccccattagttttgatgacctgtggggtggtcagtgactcactcagtgcttctgtgtgtcactatattgccagcacgttgaagggtgtgctgatgtgtacatttctgtgtctatctgaggggtgggtacctgtgtgcaggagtgtattggaagttccatctggacaatgatttgggtgacttttaaccttttaagcctgaagcagtctcaagcacctcctctctggcagatcactgtatggggaagtagacaagggctacttaggggaacccagcatctgctggtatctttcccatagctgttcttgtgtcagccctctagcccctgatagattctctttccacctcttgtcttcacccaaagggagggatagcagcatgtctaagactgggaaaggttgggggagatggtgtgggtgtgtattatcttttactctgggccaaatgagtggggtttgccacttggggggctttctgctgccagaggatgagccataggtgagaacatgacttacagggagttaaagaagcaaggcaaggccaagcctcaaatctgccactaaccctggattgcgggccacacacctcacttgcttcacctgtgtcatgggagattgatggtgacttggatgaacagaagtagacctggtgacagttgttacaactctgagatgctcccctattcctttatctgatcctctactatgcctccatttctcaggggggagtcagggccctgaaaagagccctgggcctggtaggactaacaggagttgggatgtgtccccatggagggagagggagctaacttatgctgggaggatggagcaagaccacaatgtagcccatctgtgttctagctcaggctctgtggtgtgaccttgggcacacttcttcccctctctgggccttaatatacccatctgtagtataaaggagttgaacaggaagctatctaagggtccttctaaccataaaaatgctaagattttgtgatgatttggaaggatgaagctgtctgccttctctagacacaaacctcatgtttcagtctctccatctgtaaattgggaagaataatgctgttattggtatatatgttggatctggagatttccagtctgtctaaggagatctccagtcatctcatccccaagccagaactcagaacctcactgcccggtacctcagcccaaggtgagccctaggaatctccatggcaacaaactggttatgaacggggctgcagttgccatggtgacaggctgctctctctttctctctcatccccctcctctcccctccccttttctcaatgaaccagagcgatctttaggcctcagttctccaggtggggtggggatcggggggtgagtgcagtgagaaaggggtccggattgggaaagagggaagatggactgagtctgcagaggaatgaggggctgttggggtgctgttgctatggtgatggggctgcagcctgttaattaaacccccggttgccacggagacagtggtggttgacgtgctccgcagtgagccctgtgtgtgtggggcgtgctttgcgctggactcatcaattcactgctacagttttgggtccgaggatggggcatgcgggtggggaagaagaagagtgaaggagggcattcaggaccctgggcccataaggccacagccagcggtgggtgggttaggttgtgggggtaatgcagtggagatgcggagggagagggattgagccataaggaggaatgctatgcctgcctcctgtgaaaagaggacccagtccggtggctctagcttcctccaaccagccccttgtcctggttcagtggatggagtcccggacaggaggtcaaggggctgggttctagtccctagtctgttacaagttcaccccatgaagaaaatatgaacctttccattttcagactccaatttcacaataagtggagagtggaaaataatttataatatctcttccagttcccaaatcctgacactcaggaggcagcttctctgagcttttttctctctgagacatatggtgggagggggtatgagtttgagagactcagagtttagaaataggaccctccctagccctgcatcttgtgctgctttagtgagagggtttctctggccccagatctccccagggttcttggtggggaggggatgctgtactggcagccaggttcctggggctctgagctgtgggtcactttttactggccagtgccaggctggcagtgtggtgggtgcctgccatgtgttttctctgaacctcaccacagagagttggctggaggccagaatagggcacagtcttcctgagaggtgaggggtgtcagtggaggggctggggtccccccttgggactgtctgctcacttggtcggggctccttaggaagggatatgtggctttggtctgagattaatagagcactaagagttttcagagcaggaagaagtgccatggattatacgacctaactcatttttacagacgggatactgaggcccacagagaggaacctgattttgcccagagatacacagagaatttgggggcagaggatatgacagaaccactatctcctgaatctcagatggctcttgagatgggaactctagtgaaggtggacagatgggttccccagggaaagaggaatcactcctgccttcacccgtactccctagaatctaggtttccccatgcatgggcttagtctctgagtggccaaagctggaccacaaatgaaggaaaataaccccaggggaacatgccagacctaggattactgaaaaaccttagcatctccttcattctacagcacttctctgacaaacatgctacacgtgttttactgttatgcatctctgcagagtagtagaacacagtgctgctgctgctgctagtgctgtgtgtgtgtagagtggagtggcatgcttaaaaatttttgaacactggcttcttttaacctctgtcaccaattcaaactcatctcacccttttggtggtttttttctctgggagagccaagaataccagtgcccacaacttgtctgaatagctaactctccaccctgaaaggtcctttgggtatccaaaaaaccaagtggcagcgatacttgattggtaggtccctcagaggcacttttgagtcagctgctgaaaactccacggttgacccaatctgaagccactgacaaattgtattaatacaagtaaagctgagccctggatcctgtccatggtcctgaaaaaagtcctgtcctataccccggtctccagggatatgaatggctctttaggatttttgcaggttttctggaggcttccccttcagttgcaagccaagagtccattctagccctgcacctctgaagcctgagcacaagaaaaggaataaagcacatctcagatgtagtgcctgtttgtttgtttgtttgtttgtttgtttttcaggagctaataatcagaggctgctgaggggcatggatatgactgcatccttgtctcttctatggaggcaagacgacttttataagttctatcaatgaagagagtcctaaactggagtaaagcaaactggatgctagaccaaattctgccatccactggcattatgtccacaggcagtcattttccctctatgggccttagttttttcatctgtgaaatgaaagctgtgtgtaagatacaatgactgatcttttcccaaccgaagaacttttctggaacttagagagccagggagagagctagtaccagtgtgaagattgtttaccccgatctgctcccaccctcagatgtttagatcttctagagactcaaagctttcaaacctctgatgccacttcctgagatgtctgcaccactggctcaaacctggactctaggggctctgaggggtcccaggatgatcaagcttctgggggattggcctaagggaagaggggaggaggacagagagcatgtcggctctggaagcctcagaaagcaatcctggattaggggattagacacttctgccccaggagaaaatctggtctcaaaccgacaggcggcctcattccgccctcccccactctgtccctggccagcctcaggaccggcctgtcctccctagaggctgcaccatccctgatggaaagtcagtgctccctggaaactcactgctgcctcttctgctcctcctcaccaggtcttatctctagatcagtccgcagtcagaaggtccctggctgtgggctccagggacttgtcttgggggtgggacgctgggactcttgtcagtctaagcacaatgagagagttccttggaacttctcaggcgctaccccacccattttaagacagattgggtcagtcagcccagtgacctgaacgcccctgggggtagcacattgcttaattatgggccctgggctctacatgcctccagctccaatctcttgagcagtggtatgaaagagggtctggttctcctcccccacttcagggctggcctctccagtcttgcagagaggcttcccaagggccccatgttccatggcgcacctccacggccacttcagtgccctttatcttccccctgggggttaccccagacccccagtcaagcagccgctgcggggccgcctccccgcggccgcgacctagttccctgccgttatttttagggcgcgggatggcacctgcccacgtgccgggccccgcccggagagtgggtggggggagctgcgtctgctcaagggaggcgaggccctgtcccccgaagcacccccttcatcccacccacgcaatcccccagtttttgtgcaagggggccactagtcgggctctgcccgcccctcatcttctcttctctctccctcccgctctccccccaaaaccccgccagtggctcacgcctcctgcatacgggatgaggtgagcagcgccgctgctgagagggggcgcgcgcgggtgtgagcgtgtgtccgtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtaagctgtggtccgggggcggcgggggagggggcagcgaggagaggaggcagctctggggttagaggcggagcgggggccacctccttcagagaggaggctgggactgacccgggcggtgggcgccagttgcagcctggagctcagctccattggaatgctccgggcgctgtccaaggtgctggaatgcgccgcgcccgggggcagagctgcgggccgggggattatcgctgcccacggcttcgggctgacttgggttagctaaaccgaggaggcggtgggaaggggatagaagacctagaatgggctgatgtggagctcgacggcgggaggagggctcctttccccgacaggggaccccggcgtcctggcgcagagcaggcacccgtggagccggggggcgcagtctgctgcagtccctcgttctaagacttccatctggaagatgggggaagaggtggctgtgtgtgtgtgtgtgtgtgtgtgtgtgtgtgcgcgcgcgtgcgtatgtgtgtgtgtgcgtgtgtgtgtgtgtgtgtgtgtgtagggggtttggagccatatgacagccccccgtccgggctgtggtgtctccttaagacacccagattgtccccttggtgcaatctgggacccctcccccaaggcttcccaaggtccgacctcagactgaagcgtacttcctccatagattttcagctctactttgcagaatctctctctcgctttcccgtgggttcctattcaggacgggaagcaagatcaccctcctttcttccctctttccccctcctctcagttccctggggcggtccagggcggggcgggggggagtctttttagttagctctgctagcttccccagtgaggcctcagaaatggggtcccagtggctgattcctcagcgccgcgacgcggacactgcggacgcgctgcggtgggtgcggagactcgcaaggagccgaggggcttgggacaagtcctttcgctgctcccgctctcccccgccctcctccgcggcttccttgctccgaggtcttggggccagccaccccctcaggctcccaggccccccgccgcccccgagcggtctcagccatccatcacggctgtcagccacccccaccccccactctccagcggcgctgcgtcccctgcgcactagcgcgcctcccgcgcctgctgtctgcgctcagcgccttcaaacgttcccctgggcactgcttgaccctatgagcctagactcccgcagatccctctggcggatggcgcctagggctgaaagagcagggtcttctagggattggcaaccttgactctgaggtcctccggatcctggatctcagggccaagtggccgcttggaaaggctggggacaccagggtccctgatcctttgtctgactcccccccaccccccgccgcttcccgcaactcctcattcctcctgggggctgagtggtatacaggtgccagaactcctagctggccctctcatccacctccccagtgaccctgggatcacctcatccagcatccgccccctcccccgcgggcttctggccggagggggagggggtttggcaaagttgagtctgcggcagcgccaggcatcccgacgcggatctttccatccgggatccccttcagatgcctccactctgagagggggactcagatggagagcatctctctgttccctcagacaccaggtatggtcccatttcccagcacccgctttctctgccaaggtttcaccaggccttggggtttccacaggggctcaggaggcctagaaaagaggcatcagtgtgtgtgaggcaagagttgaactaggaactcgcttcagttctatcccctctccgttagtttctagacactgagtgcagcggacccatctggagaccttctttctatacatagggtccaggacctggaactcaaatggccagaacctgggtcatgtgctgtgggtcccagagagagaagtcccccctcctccaagcggtgcttggagatggtagtaggaggtgctaaggaccttctgggcttgagagaggaccatcaggccaagagcccctgacatctctgattctagattcttggggatgtacgggaaggaactggttgctgacctcgggcaggtggggatgacccgagcaagagggcacttctggactaaagaagagcccagggatgtgtcccggtcttctttctccttggggtctgacgccccgtctccctctcggacctggcctagggattcccccaggcccagccccaggccccggggaggcttcttagcctgcgccgctcgcctgtttcctccccgggagctctggccgccgcagcttaattgaaagccgattcgggttgagagctcccagggggcgggggcggggagggctcagcctcagtctggccctgcctctcgcgcgcgcgccgctcggcgctcccgccatcacccttactccttggctccggggaatcagggcgagtttccccttagctgttctggtcctttgagaactcggaagctcattccccatccccctcaaccagtgcgcctggcgttcagggaggggacgaaatcagccctggctgacaagtcccgggagcctggcgtcccgcccaggcagctactggaaaggcgggacccagaactagcctacctagccgccctctcccctgccctcatctcctggcccggatccggcctggagtctggctccgcgctgcgcgccgcgttacataagcggctgcgggcgcgcggccggctaggctcggcgctgcgctctcggcctgcgcggtcgccatggagaccggcgcggggccacctagttgcagggtctcgggccaggaagcccctattcctgtcccctgagcgccacccgcccccgcgaaggaggaggcgcttgggagggggtgtgaaaggcagaggggaggggttctcctgtctggttgtcctggccctaagaggggatgctgcggggaaatggacccagctccataggagacaggaccccaaaatcttgcggctggatatgcggctggagatgtgggatggggagccccggctgggtgggcaccaagtatgttaataataatcgcaattgtaatgatagcaatagccacactcgtggcgggcacacctaatatgcatgatttaatttaatcctagcaacagccctatgagttaagcttggttagtatccctttgcaaaggaggaaactgaggcgtagagaatttgtgacttgctgaaagtgacgacacagccagtgaagctgggactggaatgtcagtttccataactccagcccccttttttaaccgttaggaaacatcctttcacctcaggtcccctcagtctctagtccacaccatgatgtgctgagaacaggaggcatactatcagcattttaaaaggacctcttccttgtttctcctgttctctggccccagagagctcttctgagaccctggggtccagaagggagccctggagaacttagctccaaagacttttcctgagcacctattatgtgctgggaggtgggtctcttattcccaggaactcacatatgtgagaagaaagagctgacgattgcaccctatttgacaaccgggagtttctgccttgatggatgaggtggaggtggtggcagaagactgggtggtgggtttctttggagcaggcgaggcatcactcctcctggcccaatttttagtcaggaagagattggttttataacagagacaggccatgctctggctgggtgactgaggaaggtttcccggaggtagagaggaggatggggaagacgcagacggatggagatggggagaaagggatgtcagccatcgaggggacaggagaatctaggtgcctagggcctcaatttcacttggaatttgatcagcggggagtttctccagtgtccagagagatgtcaactgctggaattcagccccggaattgaggaagggtcatggctgaagccaaggaaatgtacctatggggcctcttatatctttctgaagggaccttcccccctggtgcccaagatactttctcctcgagtgatctcatctaggcacatggcttcacacgcatactacacatgtttacatagcttacccccatctctttctcctgcctagcctctttgctgcatgtatcctgattcgtatatccaggtggcttctgcatgtatccacttgagtgccctacagtgcctcaccctcagctaaattcagcatcttccccacctccaaactccttctcttctagtcttcccatttatcaaatagcaccatcatccaaccattcacccatgctagaaaccgcagacattatcctaggttcttcctctccccctccccaaacatctggcatggaaatatgccaataattctgtctgttgctctacattgctctggtcaggcacatcatcagcccttacctgggttactgaaagtctctaactacggtactctgttttcttcacctaaaagccagagtgatggctctaaaacatgggtttattcatggtattttttttttgcctgaaactcttcaatgactccccattgccctctggatgaggtccacattcttgaacacgacctgctaatcatttaagggaccagcctgcgcttcccttcccaggctcaccttttcacttttcactgccccttccacagactccagccagatcatacttcattcctctaacccactctattcactgtcacctctgggccattgaacatgctgttctgctattctgtctgcctggaacaccctcccttcctccctcccaggctagctcttactcattcttcagctctcagcggacacgtcacttcctctgggaagactcccatgacctcccaatctgggctggatgcctctcctgtgtcccagtcccttgatcttctatcctagaattgaccatgccagattggaaattcctggctactggtttgtctccctgcacttgggttgctttcctgagaacaaggatgatgtcttctgtgtcttaccctgcttcccccatgcctgtattggcacacggtagacacttggtaaacacattgtgaatgaagatgaataaagggcataggagatgtcagagggggtcacttcttcaagaagtggcacatccttggggccttgatctgtagtgctcctggaaggcagaccttctccactgggaaagaacatgcctccaccccaaacaccggtatgagcccagctatagttaagaaggaaactctggagagtcttggggtgtcctggtaaatggaataggacccccaagagcaaggaagcactcacacatctgttaatacgcagtgcataccagctagtgcattaggctctgtatacatgctgtcaactgcaaccctgcaaggaaggtggtattagccccattttcccaatgcgcgaactgagattcagagggctactgtggctacaccactgtatgcccaggtggttggacaacaactgattggttccagatccctgacccctctcccttctcaggtgatggcaaccccaaggaaagcagtcccttcatcaacagcaccgacacagagaagggaaaggagtatgatggcaagaacatggccttgtttgaggtgggctgctagggctgttgggcccccacctacaattcattatcctgattcatcagctgctctctccctccctccctagggagcaataccctcgtctccacccctcccttgagtctaccttcttccttgagcctccccatccctccttctccctcctgggatttactccctctgctccctgccctctcctcatcctaccattcttacccctgttctcctcacctgttcctcctcctttcccatctcatcccaacctgaatagtttcgtgctccttgtccccatctcttcctctgcccttcgccacccagctcactccacttgctcccccagcctcctagcactgacaccctccctccataggaggagatggacaccagccctatggtgtcctccttgctcagtggcctggccaactacaccaacctgccccagggaagtagggagcatgaagaggcagaaaacaatgagggtggaaaaaagaagccggtgcaggtgaggacctcgggggatgagaaatggaagaaaagggacggatggggggtgggggaggatgggggaggaaaatggatttgaatggagggagggaaaggggatacaaatcagaaagaagagggatgaagggttgagaatagagagaagaggaaggtgggggcagagaaacatggaggaggagcacacctggggtgttcgtaatgatgaggactgcagagactgatgctggcctccctggcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtgtgagtgacacccctcccctcaccaccccctgacagctggggcttggcagaggcctgggggtgggaggtgggaggatggaagcatgagacctgagctttttataggaaccactgcttatgatctttgagagtaaattaggcctgactggtccttcctgcatctcacaggcttgtccttgatggctgttaaccaggtttcacctggatctctctgtgtgtaattacacaagtgatgcagctcattgatggaaatgataagggtagggaagaaaataaaattcacctataatcttacaatagttaacattttggcaggtccagactcacaaaaatgagattacatgtcacaaacagcattgtaaccaaattcttcccattctctctaaaaaaatcaaatattcgccaaacacctacttcttgatatatttacatgtcctcgtacataaccttgagacagctctgcatgtgaggtacgcagtgtcggagctgttactcctattctatagatggagaaactgaggcttggagaagtgaagtgagttgtctcaggtcaggcagctggtctgagaccaggctgggatttccagagctctctgatgctgtggcttgcttgggctccttccgttcgcatggtgaataaggttttcttgagaagaaggacttggcaggagtagaagttggaacaggtccagggagcagctcagcagaagagaacctgtgggtttggctggtgtttatggggtataaggcttggcccccacccaggccactgcggcccctaccccagccaccgctctgatgatctctttcctcacagacgatgctcacggccatctccatgagtgcaattgcaacgaatggtgttgtgcctggtaggtgactggggctttgtggggagggaggatggctgggtggaaggagggatagtgccctgggctttgggggacatcaaggcccaagagagataatattctagactagggggctgggctgtatctgttttcagccctattgggggcagaggaggaggcagctctcggtgttgaatagggcagccctcccccaactcatcctgagaccctcctctccaccatccaattttctgagccatgacctccttaaaggggtaattagcaacatggtaattagtgctgcaaaatccatgcagagtggttgcttgggtctctcaccagtcccctttctagggctgcagcccataagcctgtgaggcctggagcaacccccttctgcctctgtcactgaacacccctcaccccttacggcagcccagtgcccccgaccctctcgctgataccagattctccctgcagctggtggctcctactacatgatttccaggtctctgggcccagagtttgggggtgccgtgggcctctgcttctacctgggcactacctttgcaggagccatgtacatcctgggcaccatcgaaatcctgctggtaagagaggctgaggaggaggtgtggaaccccaggttgtcagtcagttaatcagtgctccctggacacctcctataggccaggccattcagtgaggccaaaaatgtggttcagtaaggccaaagtcagatgtggttctgtttctaaagagttcacagtctagttggggagacaagatacaataattatgtaacatacacagctgtcgtttatcaggcccccactgagctctcagcatccttccaagtgctttccagccattctcttgtatccttacgaggtttaagtattatgatgcccattttacaaatgagaagctcagagaggtgagataacttcctcaaggtcactcagctctcagataggcggcagaggtgggttgatgagttaaaatatggtagaaataaaaacagtaatgttatgcagcagctaccattgtgtgattgcctcccaaggggcatggactgtgctaggtactctatgatgttaatggtagatggctggtggctattggattgcaaaagagaagaaccaggggagggatccgtataaagacatctgttgggaatagtgactgatggagagaaaccaggttgctgggcagtgcttgaagtcaggactggtgacttaggtctccatccttcatccccttcctgtagggcatgggtgctgaagaggtgtccctggtggataggaagtagagctgacatgtcccaagcccctactctgtgcaggccccaaggcttgaagtatatcattttattttatcgtcatgactctctcatgagttaaaggtggccattttattttattttattttttatttcttttgagacagagtctcactctgttgcccaggctggagggcagtggtgcagtcactgacagcctcgacttcccaggttcaaatgatcccccccaccagttcagcctcccaagtagctggtaagcaccaccatgcccagctaatttttgtatttttttgtagataggggtctcactatgttgctcaggctggtctcaaactcctgagtttaaaatgatcctcccacctcagcctcccaaagtgttgggatgacaggcgtgagccactgcacctggctaaaaggtggccattttacagatgaggaaagcaaggctcagagtttaaggaacgaatggaaggaatatgaaccttggtctttctgacttccagagccttacacaagtgatgcagcttcattgatgaaaatgataagggtagagaagaaaataaaattcacctataatcttacaatagttaacatatggtaggtccagactcacaaaaaatgagattacatgtcacaaacagcattgtaactgaattcttcccattctctctaaaaaatcaaatattcaccaaacgcctacttcttgatacatttacgtgtcctctataccacactgccttggaaacctagaactagaaggtgtcacagcaattagtgtcacggcaggatggaagagggtaggacagggaggatggatggggcatgaaaggcctgaggaggcaaatgatgagggagaatagacctccatgacttctaaaaattaaaatatttgaaaattgttgtaaatgcaattctgcccattgcagaaaattgggggaatatccaagtcatgaaaaaatgtaaagaaggaaataagtcacccaaagaaaataaccattaacattttggtgtattgccttctagtttttgtttttctatgtggtattgtattctgtctatgtaaaatataaccctatacctaagcaactcatattctctttgtatatattatttgcagtgaaaataactcttggaagaatgtaaacgttaatatttagcatgggaattttagaaaatacagatgtgcataaagaatagattatccacattttttacgattcagggaaaactactgacaacattttgatgtacttatgaaaacacatacagacgtatactaatatacgtatatatcttcacatacacatttataaaaatgagataatgagacatattctttttcaaaaacctgattgtgttcacctaatgtaccatggatagcttttaaagtcagtccatataaatctatgtcatctggccgggcacagtggctcatgcctgtaatcccagaactttgggaggccgaggcagttggatcacctgaggtcaggagttcgagaccagcctgactgatacggtgaaaccccgtctctactaaaaatacaaaaattagccaggggtggtggtgggcacctctaatcccagctactcgggaggctgaggcaggagaatcacttgaacccaggaggtggaggttgcagtgagccaagatcgtgccactgcactccagcctgggcaacaagaacaaaactttatttcaaaaaaaaaacaaaaaaaccaccaccacaataaaaaaccaacaacaacaataaaaaaccaactacatcatcttttttaatagctccatagtctgtggggatatcatgatttattcacccaacctcgagtgatgaacatttatttccacctttctattagaaattattaaaatgataaataattattaagaattataattaacaaaaataacagaagtaattgcttccagcatccttgcaatgtcattttttaaaaaatgtatttttatttgtttttgagatggggtcacattatgttgcctaggctggtattgaaatcctggcttcaagtgatcctcccaccttggcctctcaaaacactgggatcacaggtgtgagccaccatgcctggccttataatgtcatttttaaatggctgcatcatagtccttgcaggacaggccatgccttctttagcgattctcctattactggatgtcttttccagtctggtaccactgtgactgtgctgtgatgagcatcttttttcctaaagcgctgcatgtagtgcaaagggctgctgacttaggtatctgttcttcctgcccctttcccacaggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgtgagtgctgctgctctgagcccaaggaatcgtcctcctacctccctggccctgtttcagagtctctgccaaactccccctccctgcccctcagaatctcagagtggtgtgggttgggagtagcttcccttgggagggaaaatctctcttagtttgggggcaatctcttcagagtgaggtaacttttctggaggagggaacaatttaccttgtaagagtcaacttcttgctggtagggtggacttaggaagaattaagtgggaatgagttccaaagcaatgaatgctgtctgtggtagggaaacctttcctgggtggggacaacctcctggaatgggacaatctcctagtgttggacaactcctccaggatgggaaaagacacagaagtctacagggtccagggactcagatccaagtccactccatccactgctcagaggtggagggcggcccccgagaccgctgtccacggtgctgaaacacagcattgcactaatgcggtgcttctccaccttggctgcttattagaatcacttggggagcttaagaaaaaaaaaaaaaagccaatggccaggcttcatttaaattaaacgaggaactctggatatggggacctggcgtccgtgtgtttaaaaggtctcccggtggctgtattgtgcagcgagggcaaggttatgtggctccccaccttcctcccttgtttctctccctaggatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaaggtctgcggagggacaagggctggcatccagggaacgctgcagggattgtaggttaagcggtcaggattaaggggccctccttgggattcagctaaattcaatcagctttaattgagcacctactctgagttacattctgtccttggcatcagggaggagtaaggtgaaaaggagacaagtatctcaccgctagtaggaaaagaagtcatcaacgtaacaggtggtcactgagcacctacagagtgcccagcattgtgctgagtgctaggaacacaaaataaataagccacagttcctggcctcaaggagactaatggcagaaatagatgtaatagcaaatacattatgccatatgtagatgtgcattcaatgcacagagaatgcccggggggggagagttcatgtgtataagatggcaataggcttcctggactcaactgaggagggttttgaaggacaaatgaaagatcttcaattctatgagaggagtaaggaaattgcaaccagaagaacagcttgcctaaaagcaggcagaggcagaagagtttattgtgtctttccaatcacaagtaatttggtatgactggggcataaagagcaaaataaggtggagaaagaagcgatgtaggagaggctggcatgagccagatcatggcaggccttggaagccattttggagagttgggaccacattctgaaggcaatgaggagccaccaaggggttttgggaaagggagggacgtggtcagatctccattttttgaaggttcattctggctgctaatgtggatgggttaaaggggtgagaggagagaggcagggggcccaggaaggggctgaggctatgagtccaggagagagagatggtggttttctgagtgagagtgatggaatgatgtctgtgggaattactgcagtgcttctcaaccagggctgttttgccacccagtaaacatttggctgtgtctgcagacgtttttggttgtcaaaactggaggggtgtacctggcatctagtaggtagaggccacgatgctgctaaacatcctacaatgctataggacagtcctccacagcaaagaattatctggccgggagtgtcactagtgccacagtggagagaccttggaatggagagaaggggcatatttaagaaatattaaggaggggttaaaggacagaagttggaggtggtattgaagttggggaaggggagagggagcagtgtagggcagggtgtcagaattgatgatggtgccatttactgaaatatgggatgcaggaaaggagctggtttggggtgggtggagggtgagatcaatttgggacacatcgactcaatctgagatgggtctttatttgctcatttactccactagattggactgtttgatggtagtgactgggtctgattagtctgtgaaaggtctgtacatagcctggcccaaatcaggagcttaggaaatgtcagtggaaatgaaatagagataaggccggggagagtgagatggggttgatcttgaccctgactttttgccccctcccacctcctggtcccagagctctggtccccttatggctggcctccccctgagcattctgtctccccacagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacaggtgaaggggagctcagagagggaagactctgcctgtgagtggatggggaagagagagtcgatgatgatgttgggaatttcttagtccaaaaaccccatcatgaaagcaaccgtaacatttcacttcccattggagagatgagggaattaaggccaggagaagctaagtaacatgtccaaggtctcacacaagccagtatgttaggactagatcccagactcactgaccctgagggtggtgcccttttttctcatctgtctggtctcctgtggccctggcttgagtcctagctgcacttctgttttgcagggatcatggctggttctaaccgctctggggacctgagggatgcccagaagtcaatccccactggcaccatcctggccatcgccaccacctctgctgtctgtatcctgcacagctgtgctgggaccaccctcgggggagggcaagagggagggcagctgaacttgctgccttacctgctggtgcaggaagggtggggagggggaggactgaaccgtggggattctcctttatcctctgctgcagacatcagctccgttgttctgtttggggcctgcattgagggggtcgtcctgcgggacaagtaagataattggggttgatcctattctgggggaggggtgggtatagaaggctgagttctgggaaacagacccatcaggaggtgctgggacctgtgtgaggggcctgtgggagggaggccacggggattgcttgcaaagtcatcttcttatatttcatcttccttctgtcactccagtttgagaagcttggatggtgtctcatttcctttaggataatgatactttccttttctttaaaatggattaattcaatagtgtgtctaacatttactgaatgtccatgtgttggtcacacagacaggagtggtatttatctgtgttccctccgagattctggaggcagcacagataaataacacatggtttttgtactgaaggagctcttcttggtgggtctatactggccaacagactttaagtgcagtcggtaggggtggccatacaggaaagcccaggggcttcagtccagtccttagggatcttcccagggaagtcttctcagaggaggggaggctagaagtgtcttatacactttatctcacttatccttcctgcttttaaggctgagcagagattaggcagcttggaggaagggcattccaggcaatggggagccagggtggaggggagaaatgtgtgcgcatgcctgcagctgtgagtgctcactgtcctggagcactcatgtctgaagggcatgagcacacacaactggccgggtggtgtaggaggtcctctcagaatcactttccactggtaccaccaggcttctgtaagggaatgcagtgggggacgtggggctgggacctatgctggagacaggcctagaggcctggttttcagtatcaggaaattagagaattattttatcaaggaaaaaacaatggaacatttggggctctgcctcccctgtcacccttacagaacttagtcctgtggcaggcacacagttggttctgtagttggtatggagacctgccctggaaatccaggcagcactgctcacctggcatctcctgtccacatcattccaggtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtcagtgtgggagaagaacagcccaccctcagtagaccagccaggcccctgcccagagagaccacacagtgacccagggccataaccagccttagactacctcctgggccacttctgctctgtactgcactggccaggcctatctggcagggtctgaggcacagggacagggtggtgtggggtgtcaggagttgggcagggcattgggtggtgccctgtctgtggcttctccttcacccagatggaaggataagtgtgtcttacttgggatttggcccatggtcagtgcatcccttggagcactgtctgctcttggggaaaaaataaatggccctgttttggcactgtggttggtcggagacctggggaggcagtcaaagggcaagaaaagggtagcttttaccatggtgctaaaaaaaaaagacggatggagcacagggtcgtggtggcttgctggcttcctgacagctcctctcccatctggtcctctgcagctgctttccccctctagggatcatttgaacttcatggcactggggtgccgatctcagggtgggcaagatgcagcgaaagcctgttatccatttgcattctcctggaggaagagaaatgcatcctctcccttcctcctctttggtgataggattcctgcctctactccactggttcccgaggctaggggagagggctgagaaatccttgaggtctcagtcccatgatgattgctctttccccaggtctttggccatggcaaggccaatggagagccgacctgggccctgctcctgactgcctgcatctgcgagattggcatcctcattgcatccctcgacgaggtggcccccatcctctctatgtgcgtgcctgacttcttgccctcccccctggttcagggtgtttctctatctgaatcctgcagccgttacctgtgacaacccacccagacactttagcaaccccaggaagttccccattggtcatagaagcccatcgtttgttatagagagattcatccacacgtgttattagggtgtgttgtgagggtatttggcttgaaaccccttcctaagcaccacagcatgatctggccacctcctgacttcctgtcccctttccccctttctctgcccatgctgttgtttctgtttctgcctccctttgcatctctgtctcccctggggccttcctgtgttccaggttcttcctgatgtgctacatgtttgtgaatctggcctgtgcagtgcagacgctgctgaggacacccaactggaggccacgctttcgatattaccactggtgggtgctctgtccccacacttccactgagccacttgctcacctccacgccaatcctcatcttactccagtccatcccctctgggtctaaggaccccaaacctgaagaggacatccttttttctccagcttttgttgaccaactcacatgaggaaggtccccgagagggtctcctaacaatcataaataataacatagcagcatcataagcggtctcagctggaatctctctcctgtccgtgatgcccaatagctcacaatgtagcagggaggctggaagtcagctggccagagttcaaatcatgactctgcacttcctagctgtgagatcttgggctgatgatgtagcttctcagaacctcagtttcctcagctgtgaaatgggcatgatagctgcacctgcctgtgggttcttgtgaggactacagtacatggcagatgctcattgcacagaggctgtagttctctcatcattttcctctatggctcttcatcctcacaataggccctcgggggcagacagagcagaaatgatcatgcttgtcctacaaaaggaaactgaggcccaaagagggcaagggaccggcccaaggtcccccagcaagactgtgacacaactgggctagaaccagggctgcccactcctgtctggatgctccggctttgctggtggccttctcctgggaggacccgtttccactcccctgagaccctggcctcagaatgcacctggccaggcctgtctggcagggtctgaggaacagggacagggtggtgtggggtgtcaggagttgggcagggcattgggtagtgccctgtctgtggcttctctttcacccagaagatcccatatccccgtagtcctcatggggatgatggtgtgagttcccctagaccgggctgtcacctcccaggtcttgcccatgccctgccccatctccctcttgctttctaagtcccagcttcagcaacagccctgctggggctcagaggctgggtctccccaccttgtctaggaccctctccttcctgggcatgagcctctgcctggccctcatgttcatctgctcctggtattatgcactggtagccatgctcattgctggactcatctacaagtacattgagtaccgtgggtgagtgtggggagtggaggttggggtggctggggaaggctgaagggtggtgggaaggagagggaaggggtcatgagggattggggtggtgggggtgagatgaagcagggagtgggagaggatggggctggagtagagggagagggtgatatgggatgacattggaagatggggggtgggagcagaggctttgagaaatggacaggaatggtgagagaatggatttagaagtgattttccaaggaaacttagccaaggcttggttgagtctgttggcaggagtgatacacatgtcctttctgagcctgagagatggctctgccctggggtagctggtgcagtgtagatggttctccctgccccctcctggctttctgctctcatgtgatccacttcccggctcccagggcagagaaggagtggggcgatgggatacgaggtctgtctctcagtgcggctcgctatgccctcttacgcctggaggaagggcccccacacaccaagaactggaggttagtggtgagggcacgggtgtgcataagagtgtgtgtgcatgagtgcaaggctcaggagacagggggaagggagcagggcctgacttatcctgcttgctttgttttgctgagtcgtgccctaaaagcccagccttgtctgattccttcccacctgaaacactgaggctgagctgagttccagacatttatgtgggtatgtaaatgtccacataccccaccatgctagcctcctgagcagtcatccattcattcatttcatcatttccatcattttttcataaaacatgaatgcctgatgtatggcaagtccccttctagtctctggggatgtaggaagctcacagttttgtggagaagacacacatggggacagacaaacatcagatcatgtagcatttgctctgagacaggtggaatcgttccctttgagagttataggggctcttaggcatctctagattaatgacaattcatccattttattcacgtgaaaatcagggatgccgagcgcggtggctcatgcctgtaacccaacagtttgggaggctgaggcaggtggatcacttgaggccaggggtttgagacaagcctggacaacatggcgagaccccatctgtgctaaaaatacaaaaattagccaggcatggtggcgtgcacctgtagtcccagctactcaggatactgaggcagaatagcttgaacccaggaggcagaggttatagtgagccgagattgtaccactgcactccagcctgggtgacagagtgagaccctgtctcaaaaaaaaaaagggggaaattggaggtcagagaggatctcacaggtcacagaaggcagacctggagatggaatcctcacaccccacctcttagccctgggtgctgcatgcccaacccctcactcatctccctgtgtttcaccttgccaagagtagagcctgaaaccctgacttaggttagggcattgttgacttgtcttggctgagcccagttgactaaactgggctcccagaacctggggctctatattatttatctgtgaattcccaaatgctcagcacatggtctagcccagagtaggtgcttagagaatgctacgaagttgataggtggttggaggactaagacggctaaatgactaaggaaagggatgcataaatagatgggtagatggataagtttatgtacacgtgggcgggcaaaagcatgaatcgatggatgtaggaatggatgataggtaggtagatgtgtggataattgaatgaataatgcatgtatcagtaaagaaatatgcatatgagtggatgactgaaggataaaataggtgggtgggtggttgaatgggtagataggtgagtgaggtgaatggagaaatgggttgatgggtagatgaatggatgggtggtgaggggtataggtggatgggacagatggttatagaggagagatggctagatgacctggtggtgggtgtatggtgtgtggatggttggttacatggtatatggattatgtgactctgcacactcttcaggccacagctgctggtgctggtgcgtgtggaccaagaccagaatgtggtgcacccccagctgctctcactgacctcccagctgaaggcggggaagggcctgaccatcgtgggctctgtccttgagggcacctttctggaaaatcatccacaggcccagcgggcagaagaggtgagcagaggccctggttgggcttgggaaaaggtcaggacacttaggaagacagtctctatccttttgtactttccttcctcatcaccttcaggatcaaaggaagtgcaggcatttcttttcttttccttagaggaagagcctaagagcctagacagtgagttctttagaattcaactcacagcatgaaagaccatcagaggcagaagggcccattttatggataaggaaactgaggcttagacaagtcaggtcatatgtctaaggacagaaaatgaagattcaaattaggactccttgaactcctactctagactccttcctgccaaagtataaatctttcaaggtgatttcccagctgtggactcttgatccctacagtctggggttgacaaggtgagtatccacatttgatacaggaagaaactgagacccagagagggaaagctgcttgctgaaagtcggaaagctgcttgctgaaagtcagaaagctggtgggaagcaacatcaggatttgaactcaggcccctgctctgtgtcacctgctcttggttccacccactagtccatgcttacagggcagcctacagaaccaatgtgggctgtggtggccagtgtctgccttaagcacacaaagaggtgattggatcccaagggtagtagaggaagtaggttctgtctgagggtcaggcctttctcccatcagggctgtggctagcagtggagagagaaaaagaggcccgaaggagcagaggtgagatggggaggggcaccccgatggcttgcgacagtcgctgcttctgcctcactgggctgttcacactgatctgtcagggcccagagctggaggccttgactggtcagttccattcaacacgcggtggctgagaatgtgcagtgcaccaggcactgggcgaggcacaggggagatggagatgttcaagaccaagtcccagccctcgaggtgctcacaggctggtggggaaggcagagcatacacagaaggctctcagacccaccggatgtcgataaatgctgttagagttaataacatcagggtcgtacaatgtgttgagtgttttcaattcctcaggcaggatactaactaagccctatgtgcatgatgacatgtggttctccctattcctaaacaaggtagcttgtcctgaccccttgggtggttaggtgactcacccaaggtcacacagccaggaggtggcagagataggagttgaacttctatctgtttgacttaggggtggtggttaagagtgtgggggttggagtcagacttccctgacttgaatcctcacagtaacattagctgtgtgtccttaaacaagtcttcctttctccaagcctcagtttccccatctataaaatgggagtaataagactatttccctcatagtacagtttaaatgggagcccttaaaatacttattatgctacttagaaagattgttgaaacaaattgtctggctgtgcagagaagcccagtttaattctggtctgggtgggggtggtatctgaagacggcgacatttgagctgggccagacagggtgtcatgtacaacttggcaggggcttgtgtcagggtgatggtggagagcatgtcgggcaggggggctgtatgagcagtgggagggtggcagaaagtgtggtcagatcatgaagagccttgattgatcaagaaggaatggggcacagagatgatggggagccatgtgccattctggagccagagactgacgtgatcagagctgagcttcaggaagattgggatgaaaggaggggagagatgggagggaaggaggctacaatgggcccagccagggccagggaggcctgaggctggtccttgtcttttccccctcccctagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattggtaacgctattgggggctggggacagaagaggggtggggctgggggctgtagaggggtggaactggatttccgctcctttgggcctgaggggtttcccaagcactgcgtgccaagtgtggattcagcatatgcaggtgacagcagtcaaggctggccacgtgccagccactgtgctgggcgctggggactccgctgtgaacgagacagtcttggctcctgcagcgctcacaggccctgggaggaacacagtgcagggcagtgggaagagctacagctctgaagtcacagaggctaggcccacatctcagctctggtccttcctagctgtgtgactgtgcacacgtgactcactccctctgagatcagatttcttggtaatcgtaggtaatagtatatataataactaacgtttctagaatgagttctgtgtgccagcaagttaaggctttctctgattctctcatcagtcctaggagggctacgcattgttatctccatcttttttgatgtgaaactgaggcacagagagattaagaagtttgctccagctgggttcggtggctcacgcctgtaatcccagcactttgggaagccaaggcaggtggatcgcttgcgctcaggagtttgagctgggcaacctggcaaactacagagtaaatgaaaaagaagtttgctccaagtcacaaagtggggagccaggttttgaaccagcccggaggctacactgttagctccaagctattctgtctcctttataggtagatcatggttacaaggtgttgggaggattcagtgtggtcatacatgatgggctcttagtaatcagaaagggcaggtggtgttattgccatttgacaggtggggaaactgaggcctagagaggttgatagacgttcctagatctaaacaataaatatatgatggggcccaagtagatgctggttttctgaccactcagcccatggccaaggccagttggagtggggtggagtgctggctgccaggagcccttgtggctgctgctgggtgttgggagaaccagagtcactgtttccccctctggccctctccttggcctccctcagagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtgagttgtgtgcgtgagtgtatgcacgtgtgagtgtgtgtatgcatgtatgcatttgtgtgcatatgtgcacaactgcaggtcagactcaggggctctggccagggtcagcttccgtgtccttcctcccctgtaaactcctgggaaagggatctgctgacctacttcattctgagatgttaggaactgatggtttctcctcttgcaggtgcactgctgtaaggagagcaatgcttagcccaagccagtgatgctttctttaatgggggaccctcagacctaagcagggaaggttttgtagagagtggccccaaagacagaggatttggggtctgcatgtatgtgtgaggagtgggtgggaagaggggaagggtgagcggacagggcctggccctggatctcctcatcacatctgggctggacctttctgaatccccttcatcgcctgcaggtctggcggaagtgcaagatgcgtatcttcactgtggcccagatggatgacaatagcatccagatgaagaaggatctgaccacatttctgtatcatttacgcatcactgcggaggtcgaggtggtggagatggtgagtccccaggagacaccgctggggttccacctggccctctttcctcttggccccagcaccaagtagggcaactctaacacccatcagcttatgatgctggatcctttccccctcatccatctcttagcctctcacatattcagccatccctcccttctctataaaagtagccatgtctagtgcttattatatgccaggcactgttctatgcactttatatgtacataaattccaacaacgaccaatgagatagatacaattatcagcatttccatgttacagattaggaatatgaagtgcagagaagtacagtcacgtattcattgcttaacaacagggatatgttctgagaaatgtgttgtgaggtgattttgttgtgtgaacatcatagagtgtatttatgcacacctagctggtacagcctactacacacaaaggcttattgctcttatgctacagacttatacagcatgttactctactgagtactgtaggcaatggcaacacagtgggaagtatttgtgtgtctaaacatatctaaacatagaaaaaatacagcaaaaatacagtaatcttaagggaacaccattttatgtgcagtctgccattgacgcacatacaatggtgttatttggcatatgactgtaatttgcccaataacacagagtacctggtggaggcaggattcaaacccaggcaggctggctctagagcgtgtgcccctggtgattatcctgtagagcatcttgtccaaccatcctctcaattcatgtgtccatccacccatccctctgtgttttcattaatctacccatgtattcattgaagtattcattcactcactctcccattcattcttgcatgtattcattcatcgctttgttctttttcttctttcccttctccattcacccaggtgattaattaatccactcattcattagttcatccattcatatgcctggtcctgtgctgggctgaggagggaatgagctgcctgccttgcaagagcattgccctctctgctacgtccttgcctcctacaacccttgacaaaattaatgattgggtagggaagccctaggctgccagaaggacgggggccttccttccttcccttggcctttcacctgggctcagacctcatgctttcctccgtgttcctctccccaccccccaaccccaacctctgtctgcccacagcatgagagcgacatctcagcttacacctatgagaagacgttggtgatggagcagcgttcccagatcctcaaacagatgcatttaaccaagaatgagcgggagcgggaggtgaggttgccctggctggcccctgagagcctcaaactgctgccagttctgggtggcaggtttaggatgcctcagggctgacactcctggcatttcaacttcaccctcatctccctgattcccccaaccacacctcctgaaactgatctcccagacagcaggagtatacactgcagcttcactgccaacctcccagccaggaggcagagggactttggtatgggtgacagatcttctcctctgtatgtgacttctggagcctgagagagaagagtggatgctaaatacgtatggatgatgagtccttaggggtgtgggctgccagtgtgagggataagggctcatgtagaaacccttagagagtgggtaacagatgggtgtttagagatataactgatgtgtgggagttaggggaaaatcccctagggtgtgattgatgggatctcaggggtaatggtgataagcccccccatagggtgtgggtgtaagatcttctaggtgtgggtgatgtagaaccaccagagtatggatgaaagacccacccaagggagtggagtccttgggaaaatgagtggtgttaccccagctggggacagaagggctcctggaggtgggtgataagttgcccagggaatgggtggcaatcctacacatgagggtaatagaaccatgggttttgagtctcccaggggtgggtaatgtatttatcagaatgtggttgatggattctcagggggatgagtgatgggtaccactttgagatgggaaggatggatcctccaaggctgggagtgttatccaagggaggtagtaaaaatggtaaaacatggcatggtcactgaccagtggactgaggactgacattggaccatagtgctaggcagagccttgctgtgccaaggttaacccttttgttgccagatgaggtctggggttctggagaggaggtggggcaggcagatcagtggtgcagtagctatttggtctcaaatcatagcaatattttaacaactggtacagttccagaaagtgcatcctggctgaacatcatctctggtgatagctctttgcagggcatgggtggtgactcccagcagagctggcaccaacctatgtcactccctagatccagagtatcacagatgagtcacgaggctcaatccggagaaagaatccagccaacacgcggctccgcctgaacgtcccagaagagacggctggtgacagtgaagagaagccagaggaggaggtgtgcagcttgggtggtttggccccaaccagtgggagcagagcccttggcctccaaaggactcaactgccatcgcttcattcatccctcaggtgcagctgatccacgatcagagtgctcccagctgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccgtacgggcctgggggctaagggctgggggctggggtgagctaaagggtcttgctccccatggcagagcaagagagcagaaggcatcctggtctgtcagcctgcagacccagctcagacattgtcttggtttctccatctgaggacttagggggttgggccccattgctaagtctcagaattcccagttgcaggcagcggaaaggtgaagggtgtgggggctggcagagcaggactcagggcagatgaccatggcccaagcccccagtgtcttcctctttttctgactctgctctttttctttctctctttgcatctcttgtgtttcctgaagggagtgggagaacttgtaagtgcttcagcattttttcattctctctcctaggatggccagggtccctaccctcctcactctgttgtgaacccctaattggtgccacgacctctgggatctctgaatagcctagcctggagatgtttaggattggtggtcctaggcttgcaagaaccagtccccagcagcccagttcgggctggaagggcgactggctccaatcttctctacccccccggctcacgcggtctccactcctccttcctgccgcaggaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactgtatcctggaattaaaattgggggaaagagggaggtggacgtcagggaatctgggtcctgtccctgggatggaagagctgagctgttcctgcctccggatcagcacctcggacagggacacgggcgcgagaggtcccctggcagccgagcgcgaccccaatttcgtcgggagggaaggagaccgggtctttctccttgaccggctctcagacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggaggccacgcctgttggggctgattcggagagggcgccccgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctggagctggcgccacccagacagcgtcaggtgtggctggggtaggtttggaggtctgccagttacaccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtgttacttttttagactcccgtctgcacaaaatgcaataaaaataattttattataccctt

SEQ ID NO: 205 - DNA, 23704 bp, Homo sapiens
atgttggaattcctgatgaatctgcagtcaggtaagatttcatagatttaaaaaattatgttaactaagaaaatatagatggaagaaactaatatctgttgagtgttgtattctgggctagacatcctaatatgttctatgcatttatcatctcataaagccatcataacatctgtgttcctataacctactgttaaataaacaactatggattagagctgattaattgcctcatgatcccatagttaacaaagtagctggcctacagtttgaccatcagcctacctgccttccaaatcctttctcttgctcctcagcatagattgatagatatctgtgcagtccttggatcaaagtataggtctgaatcagatcaatcggattcattaatttgattaacttctaaattaatgagagtttaaataccttgaactctcatttaagtttattgttagaatgtggttagtcctaataaatttgacgatttcagtggtaaccagtatcttatttttaccttcaaaggctctagggcagatctgacttagctttggccataggactgtaagttttaccaaagcaagtttaggcaagtcttagagacaaattatttgacttcccagtttggttttccatttaggcaagtatttctgcttacttccataatacattttttagtcttgttgctttttccatgacttttatataatcttgtcttcattttttaaaactttcttctctgtttttcttggtgtttcttttgttctattatttttttcaaactctgctgcctatgtattccaagtttttctatagacagaatcaagaggacatagaattacagaattttaaggaatcttggaatgaattaaaataccttctagtatttttatctgcattgaacattctggtcaagtgattctctagatagagaatgtgaggctcaaagagattaggaagcttttttttttagacataggaattggcagaaatgagatttgaactcatggtaaagcccagtactcttgcttctttttatgtcctattggcgtgtgttttaataatacaaacgggagtgagcctgtggatagaatgagaatggaattagctggtgaacccaatggaagtagataagaatggaatgagcaggggaagtccaagtttgaagataaacaacactggactggataggagtacggactcttctacaagagatcaaagtattggggtttatgacaagtttgataaagataaattataaaaatgaaggacacaagatgttgggaattatctacaaaggcacattaaaatagaaggttcaagggagctctaaaaattttgctgctttttttttttaaatcaaggactgacaaacttgaagatttttactgaaagatgccaaaacattttgagacactgggaagaatgtctacagcagataaaaatgtggtgtcatctacttccatcctgacttacaaaggggtggcttagagcccctggagtactaaggggctggaaattgctgaactacatagatgtgtggcacaggacaggtgtctcctcacctctgcctcttttcacggttcactgatgtccttcccatgtccatgtgggctgggtcaggggcatgattagctggcaaatcagtcatggagttcagttgggtagttggtagtgtgtatagctggtggcaggtgatggagactccagttagcttgtttttcaggagcagggatatagagagctcctactcctggtcatttgaggccattctttcaggaatctgtgctttcatacactgaagatttgaagattggagacttctgtggaaccctgcagaagtagaatctggaagtgggtgtccataggaagaaatatacttagatagtacttagggaaatagaggtacaactatcatgactctgtttctttcctcgcagtctctctccttgggtgtctgagtgcctatgaaaatttttaagggcttgctagtttatgtggacctgaataaggtaggacctatagagtgaaaataatgggattttataattgttaatattttaatatttctgggaaaagtattctcagtaagaacatacacctttgctatttgacttctgtacatttagctttcatacatttcaaatattgtgggggctttcctgtaccaatttagggtaaaggaaagcaataggaccttcctaagttggatccatgctgaggaatcaagactaccattttgaagtgatgtagattagtcttttatccagagacagatcacagaaaagagacagtggatctttctaccttgttttaggtcatcagttttattccagtttagggaacaaaatttatgtcatccattaattgaattttaagttcagcttcaggacagataatttgtgagggcacattattgtcaggctctgccaatatattgactgtcactatttgttataaacctcaaggtaagttttcattgaatattttatagatttagacaggtggaggcagaaataggtaactaaaatctatttttagaacagaggacatattttaattatatcaagaatcataatttaatatatagatcactgacctttccccagattatgttttcctttttttgagggggaagctggatataaactggcagttaaaaaaattgtaaagaaatcaacttgctcattttcattgtgtatttttgctctcaagcattttgcataaactgtgtgtggattcattgcctacattggatgatgaagacttgagtgttgctactaaggtaaagtggtctcttgtaaaattaatcttctcactctgagtgtagttttgcatagtatttacttttcaaatttagcagtggtttacctatcattgttttatggtggtaatggaaagctggtcagagaaaaacatacacatggctagttgattcaaaaaatgtgtttaactttggtaactaataaagattggtaagtactgtgacagggtgggagctgaaaaataaatgaactggaaaacaagtagtcacaggaaaatcacattaggaaatgctttctccaatagaggaaatatgaaatttggttaaagtttatttggataaatactactactttgacttttaaatcatacgagtgtgactttcttaatatttattcctgtataaatcttcagtggatcaaattgtttgcagtaatcatggaatcctcctggtaatttttagtggcagaaatgttcagcacatagcatatagcttttgttcttggaaacttatcattttggtgtcatatagtttttaggagagattgtttctctacttatattattggttctgtagtgagactaaaaaagtattaaaaattgtagaaaaatagctgagtttggtggtgtacacctgtagtctctgctacttgggagtttgagacagtaagattgcttgaacacaggagtttgagaacagcctgggcaacattgtatctgatttaaaaatataaattgtggaaatgtagaaatttaaatttatgttctcaagatttgtattgcaaagggatttttatgtgatttatgagttgtccatgaagagtttatataaaacacttcatctaattgaataacttgtattttcctgcaaataaccagttctagaagcagagactcttaataccaatatggtaagtctttatcatcataattttgtcattgtagtttatttaaaatatttacttggccaggcgtggtggctcacacctgtaatcccagcacttttggaggccgaggtgggtagatcacctgaggtcaggagttcaagatcagcctggccaacatggtgagaccctgtctctaaaaaaaaaaaaaaaaaaaaaaaagcacaaaaattatccaggcatgatagtgcatgcctgtaatcccagttgctcaggaggccaaggcaggggaatcgcttgaacccaggaggcaaagattgcagtgagccaagattgcaccattgcactgtaggctgggtgacagagcaagactacatcttaaaaaataaaataaaataaaataaccactcaaagtccttatatcatattctgaaagtttgaatgtcagaaggttttctatttagttttttaaatgatcattggaagctcctgcataccataagctactggaggtcagtaaacatatttgtgtgtatcctggagtacctagaatacagtcttccatgtaagaagcattttacttgttgttttttgagatggggtttcactctgtcacccaggctggagggcactggtgagatcttggctcactccgatctccatttcctaggctcaggtgatcctcacacctcagccatccaagtagttgaaacaatagagctatgacaccatagacctgtgtcaccatgctgggctgagttttgtagagatagggttttgccttgttgcccaggctcttctttaactgttgggctcaggtgttctgctcgcctcagcctctcaaagtgctggggttacagacatgagacattcagccttaatagttgtttaatctgaataaataaacaaatgaatttttatataatggaatgttataagtaatataataaacctaatgtatctaatcattaaatattgtatttaaaatattgcttacattgtattattttttaatatttaagggtgtataagttttgacatgttatgttgagaaattatgccataattaaaaaggaaataaaagagaaataggtcatcggtagcaaagagggttacaatatattttctagtatcattcaactggaatcttaacattgagattttagattaacatttcttaagctttttgttagacccaactcatgttccattaaatatactgtttcaagccatacattactctttattattattattatactttaagttctagggtacatgtgcacaacgtgcaggtttgttaaatatgtatacatgtgccatgttggtgtgctgcacccattaactcgtcatttatattaggtatatctcctaatgctattcctcccctctccccccaccccatgacaggccctggtgtgtgatgttccccatcctgtgtccaagtgttctcattgttcagttcccacctatgagtgagaacatgtggtgtttggttttctgtccttgcaacagtttgctcagaatgatggtttccagcttcatccatgtccctacaaaggacatgaactcatcatttttttatgctgcatagtattccatggtgtgtaagtgccacattttcttaatccagtctatcattgatgggcatatgggttggttccaagtctttgctattgtgaatagtgccacaataaacatacatgtgcatgtgtctttatagcagcatgatttataatcctttgcatatatatccagtaatgggatggctggatcaaatggtatttctaattcttgatccttgaggaatctccacactgtcttccacaatggttgaactagtttacagtcccaccaacagtgtaaaagtgttcctatttctccacatcctctccagcacctgttgattcctgactttttaatgattgccattctaactggtgtgaaatgatatctcatagtagtttcgatttgcatttctctgatggccagtgatgatgagcattttttcatgtgtctgccatacattactctttagaattctggtgaccaattctttttctgggtggaaagttgatggaaagttccagttttctctctctgttataataatgttctttcaggtaatggtagatgaccatatttagctaattgaatgtcttatagtaagaaacactatcacagaagtacttacaaaaaactaattgcagcataaatattaattagtattatcagagttatgaaagaccgaaggctctgttatagatctatttccccatgtactttattatacttcatgtttttcgttttctttcttggcttaagctcatatttcattgactaattaggcttgttttttgtttgtatctctctttgttctcacattttaaattgaaatttttggggaggcagggtcttgctctgttgtccatgctgcagtgtagtggcatgatcttggctcactgctgtatccacctctcaggctcaagtgatcctcccacatcagcttcccaagcagctgggactacaggcacacaccatcatgcctgactccttttggtattttttgtgtagagatgtgttctcattatgttgcccaggctggtctccaactcctgaactcaagcaatccacccaccttggccttgcaaagggctgagattacaggtgtgagccaccatgcctgggcaacattgagattgatttaaagaaattgattagggctgggtgtggtggtgcacactgcttatctcaacactttgggaggcagaagtggaagatttgcttgagcccaggagcttgagaccagcctgggaggtataatgaggccttgtctctacaaagataacaataaaaacattagcatgacatgatggtatgcacctgtagttccagctatccaggaagttgaggtgggaagattgcttgaggtctggagtttgagaccacagtgagccataatcaggcccctgcattctagccctgggttgacagagtgagacccagtttcataaaaagagattgataagaaactcttgatgcaactcattataattttaaatggaaactaattcttgatattaccttagcagtgtgtccccgagaaagtgtcagagcctttacgtggaccttctcatgaaaaaggaaacagaatagtcaatggaaaaggaaaaggtgagaaccgtattttatttaaaaagtcatttgatggagaccaggcgcggtggctcacgcctgtaattccagcactttgggagcccaaggtgggcgggtaatgaggtcaggagatcaagaccatcctggctaacatggtgaaaccccatctctactaaaaacacaaaaaattagccgggcatggtggcgggtgcctgtagtcccagcaactcgggaggctgaggcaggaggatggtgtgcacctaggaggtggagcttgcagtgagcggagatcgtgccactgcactccagcctgggtgacagagtgagactccatctcaaaaaaaaaaaggcattgatggaatgtttcttttaaaatatgagcactaatagagtttaatagctaaagaaaatgtcctattaactgtatcataagtaaaagagaaatgaaatggtgataagtggtgtctctaaccaagggtcagcagttgattctattggaagtaccactaaaggagctgagttatgagttccattttaacatactctaagacctgaggcaagtcaggagagagggaagaggaaatgaataaaagagaaagaaagaatgaggagggaagagtgtacatggaataaataaaaaagagtggatgtatgtaatggagggtagtaaagtcaaattgatctgtagaagaaggaggaacagggtgttagaaataggaaggaagataaagtgagcttctagtaccaaaatgtgtcatataattacagtaacattttccttctcttgctgtcattctcgctactggggaggcattaaggattgaggtactttaccatgcagacctgtgttttatctaccatagatgaacatcactgtaaatggtcagccatgtatggctataatttgtttttatagaaaatgaaaagaatagtgttgggtgatttattgggaagaaattaattagagaagctttgcctgattaaaagttcattagaaacattatggtttataacgtagtattaaattcagggacataataagaaagaagttgaggctaggccaaaaaggccagttagggtaaaccaatatggaagcacaccagtgtggaacagggcattcaaattgtcatgaattcgttgaggagcttctggaaagtgcacattctgactcagcaggtattggagtctgcatttctcatgagcactcaggtgatgtttgtgctggtccttggacacagctctgaatagcaagggaatagctttcctttagagaaatctggaaaaagaaccactggagagcaatttaaaaaataacagaatccagggaaagctttaatttccttttatttctgagcatgattctagccacaggggaaggaaaatgagatgaaaaaagagagattacaggtgtatactactgctgaatacagatgaaaaaagtggtcacaatcatccataaaaagcagttaggaagggaagcatcaggatgacagttctgataatcattttttcaaaggaagagggatggtgaaaggacacaaaaggaggaaagaaggacatttgctggggtcttgggagttaaagccaagtaaacttgagacaactcacttccagttgcttcagcatatgcccagtctcacaaaagaggttattgctgtggagagtactggagacaggagggagtgctagagttggggtaaaccacagcagctcatttcacttgataactgtcaggcctcagggagagaagtttcactgacatgagtgaataagatatgattaacttgcatatagatgctttggtgaaatttttttgagacagccagttctttgatatgatagctgttttataaaagtcctttacagtgtaagataatataccaaacttagttaattttagaagtaatcataaaattcattccatgaaaaccaaaattatcattttcaataaatactgcactgattttgaaatataaatatgtattaatatccagcaagtctgtggtcattcaatgttttcttttttgataaatattttgatatcagaagcttattcgacatggtttatttgatgtgttttatggaccaccttgcatgagtggatcaaggagctctaattcaaggccaaatgaggggataggagaaatgtaggtgctgcagtagcccatgtgatcatgggaaaaatgagtagtttgattagctgttatttcataagtgtgtatcctagctgatcaatgtagaaccctttctttgatgagaggtgaatcccacattcatctgaactgtcatcccaactgcgtatttcctcagtgacaagacaaggggaatttatttgtgctgtgctggcagcaatgcctctggtgtgtggagttaaaatactctgtacattcaccatcagctttgacattgattctctcaggtttaatttgcccctctgtttaatggtcccttttctccttatcagtccacgtgttcacggttatatcaatgcttttctattttaagtataggcatttgaaacataatctcactaccgaaatgtaaactgtgcattttgggaatcctatattcctattttcctcattgtgtttctgtcatgttgctgtcctaggcaatgaaaagaagaagccaagaagaaccctcaaaaccttaagtaattatttttatagccaggcctgagaattcagctcgacagtaacactgcatgaatgtttggttggccctgtcatacttacatataattgatgacatatcccctttgctttgtagggcctcctgcaaaacatccttccttgaaggtaattaattatgtatatttttgaatcactaactccatgttgtataaaatatatatgatttatgaatcgttttcttttaaaacccattcagcctagcactgaagtggaagatcctgctgtgaaaggagcagtacaaagaaagaatgtacagacattgagagcaggtacatttaatggaatactgtaaataaagtacattcaatgattggatgtactcatattattcttattcctaattctatttgttcaatattgaacagaaggctttgacataaatgttattgttggtatccatatttgaataaaaacaaatttagaagcataaaaaagattttaaaaatgtaagctttaggtcagatgtttctgttttaatgttttgaatagcatgaagttttcagtataaaatttttatacttgtcagggattcaaagcagtgaattttgagactcttaagatatttccagtgagttaagtgctagttggagttctgatctttacctagaggaaagctttacttattaaagtgtcagtttctgttttaacttcagaggcttgctgctagtgttattacactgatgatctgaagcctatcagatgttctaatgagtaagactgtgtgtgtaggtgtatatatagatgtgtgtatgcgtgcgcttgtggcatctttgactactacaaatgatgaaagtaatgattcatttatgactggtagacacagccttttaaaatggtgattttgagcctttttggtgttaaagtttttaaaacatgattgcatagaggctaccaacatcataagttggttgtttttcatttcaatgcccttttgaaatctttaactacattgtgatgctcagaaataatatgcagaattttttgtgtcctaaaatggtatgtgagtggttatacagtttatatacctttctgccactttctttggtgtgttttgtattatactttccacttgtacccacattggtgtgattatctctggtttaattcattttacactgttcattgtattccctcataccactttaccacatttagttagactctcctgttgctgataaatgaagaaataaaaagaaaaataatgtcagattaagagggcttttctttaatcggtttgtatctattagcatttactatatgagagtttaaacctgaaaagttcagaatacaagcatgcaccaccatattttattaatgcccttagaactatgactcatgagcctttagcctatgaagttaggacaattcatttctctgaagaagaatgctgggctgttctcagaaaagaaaactgaaaatagcaaatgatattgtcttattttacctcttggacatccttgaatgaaactgctactaaagggatactcggatcaaaattcagatctaatgttttgaacagtatagtttgtgaatgtccagtgatcatgagcccttgatggggaaatgacctttcgagtttcacttttgcattttttgctcttttcgttgacttgtcttgaaagcttaaattcaactattttatttttacagaaaccaggaatataacttttaaaatatatgtctgtcctgtctcacggtgttgtgtactcttcagatcttgtatgaacatagacttatatgggaacaattaggttttttgtttgtttgtttgtgtttttgaggcagagtcttgctctgtcaccaaggctggagtgcagtggctcagtcttggttcattaccacctctgcctctcgggttcaagcaattctcctgcctcagcccctcgagtagctgatactacatgcacgtgctaccataccctgctaatttttctatttttagtagagatggggtttcaccagtttggccaggctgctcttgaactcctgacctcaggtgatctgcccacctcggcttgccaatgtgctgggattacaggtgggagccactgtgccagctacaaataagatttttaaggctattatattttatacaattctttggtctatgtgaattctgaaggtattcatgcattgagggaagattatctcagtttaatgaaagcagtttttaatttaacgtatattcattaaattttttttgaagtttttgtctctagtacacagaaacacacaataatgtcatgggtatttgaccttaatgtgtttatgcacaaacttagttattcaaatattttcttatccctgaagaatcttaattactaataaacaaatttctcatggaaaacaacatatataacagagatggttgagtgattgaaagtaaactgtagtaaatgccagaagcttagaacaagttaagtaaacttgtctgagttaatagcaattacaagacttttaaaatacattagaccacgggggagtagtgcatttgtggggtagaggacaacatggtactgcttcagtgaagaaagaacttttacaccttattacaatttgtattattatttacattctaataaataaaaactttattttcagatattttacatcatgtttctactagttgaaccatcaatagtaagacttttcaaagatttgggaagttgtgagttgatgataaatatctgtatcaccatcagtgatcaaaaatcagacagcaactaccacagattttggacacgcgaacttcatagttaaagaaaggattaatcttggagctgtgtttctatcaaggaattacactcttcattacctgtgtgaatcgcagttattagagtagaaagagagcaaagaaggaaaagaagcatagaaaattttattgtagattacctcgtttggcttcatgctaccgtagttctgacttttaaagagtcattttgtggtcaaatgtactttgtgttcactccccttatgcagcctacaaccaaacagaatggttcttagcaaggcatttgtattcttcccttaaggaaagcaacatataaataacaaaaagaatgagaagaaagagtgattttattgaggttggtatttaacataaatttgagtgcaggtaccatgattatatttagaattttttggctggatgggaaaaccagctagatgtctatagatttcctactcaaacacaatgtgcctttgttttacttttacgtctctaatttagcaattattaggtacaactgtatgcagtgtcactaaaaatacctcccaaaaccaaatattaaataatgtctatggctttctgttttatagtgttgattttcccaatattaatgggaaccactgagcatttgccttgtggtgtctcctccgctgtattcacatattccatcaccttttcttaatggataatcatgcgctatgagtaagggttttcagaaaagctgtgtcatttaaagataacacaggagcatcaaatttaattctgctaggacgcctggtctactgattaactgcagctaatatgaggtctacttcacatccaagttaaattcagtgcccttaatcagtcatatgatgaggtcaacagtaataaattatgcaatattttttcacccacccctatagttttaatttctttttccccttgtgtctgtgtttaacattttgctttgcaaaacatgatgataatcttctagagtagtgaggacaagctataaatccaaagtttctaacctatgcaaatgacttgtttgctctattttctcatgagcttggtagatccaggaaacagaacttttaaaacaaaatcaccatatgttgctgggtgcggtggctagtgcctgtaatcccagcactttgggaggctgaggcgggcagataacctgaggttgggagtttgagaccagcctgaccaacatggagaaacccatctctactaaaaacacaaaattagctgttcatggtggcacatgcctgtaattccagctacttgggaggctgaggcaggagaatcgcttgaacccaggaggcagaggttgccatgagctgagatcacaccattgcacttcagactgggcaggaagagtgaaattccatctcaaaaaacaaaaacaaccacaaccacaaccacaacaaccaccacaaaacccaaatgcatttccttggcacagtaaaactgaaacagaaaaagggtaaagtaaatacaagtaactgaaagagtttatgtatattattttacttctcatttgattgataaaatttgtaaagtaatgagcagagtgtatttctccagggacccagatatatacatttatttattcaatagaaattcattcttataatggccactgatacctatatcctaaatatttctgaaaacatctcctcaggcctgcatcatctttgcaacattgccttatattttatctttgttcattgatttatatgcctcagaattttatgctcctcacagtatttagagtgaattatccctaatgcaaatagatccgtgaaccggtcctgaatacctaatgtccaagcatcttaaaggtttatataaggatttcagaaactgacttctgggtagggcacggtggctcatgtctgtgatcccagcactttgggaggctgaggcaagtggatcatttgaggtcaggagttcaagaccagcctggccaacaaggtgaaaccccatctctaataaaatacaaaaattagcaggtggtagtggcacgcacctgtaatctcagctactcaggaggctgaggcaggagaattacttgaacctgggaggccgggttgcagtaagctgagatcatgccactgccctccagtctgggagacagagtataaccttgttccaaaaaagaaaagaaaaggaaactgatttctgcccaaatctccatctgtatccctttccccatctgcctttttctctggaattaccgagctgctggtaatggccccctcaccattcctcttctgcagagaaatacatactctcttggaggcttcttgtcttctcttgttgctgcctggcatgtgctcaccctttcctgccctctgcctcgcttaatctggctaacctcactctctaagtctcagctcatggatgatctttaggaaagccatccccgacagcttctattttccttccttattccccagtgcctaacacttagcaggaactcaataagtaattatttagcaaaattaagactgtttatacaaagatgattcaaaagattgtcctctacagtctagcagcaaaggggtcaacatgtaaagacatgatgtgcatgtcaggtggtaaagtgacactagaaaaattgacaaggtactaagggaccccaacgaagcagacacctgtgtgtgtggagaaagatagctagaatcaaggaagatttcacaaagcattctgagccttttttttttttcctctttttggagacaagttcttactctatcacccaggattggagtgcaatgacatgattgagactcactgaaacctcagactcctgggctcgagggatcttctcatctaagcttcttgagtagcggggacaacaggaacatatcaccatacctgtctaattttttgtagagtcaaggttacctatggttcccaggctggtcttaaactcttggccttgagcaattctcccattttggtcttccaaagtgctgggattacagatgtgagctattatgcccagcctactttctgagtcttaaaagatgaaaataaatttttcagaatagcaggggaaaacatttgtgatgtaaaaaatggggtgcacactaattgaggtataaagaacaataattttgcaaattattagtaactgccaactcaattagtgtcttgttaaaaagatactgttatgaagtatagtaaagcattacattgtatattttgactgtatttcaaatttctgttttgtttctaacagttttgttgacttatgttgggtggaacaatttgtgagtgaccctgagattttgcatggcttgaatctggtgatatctggtgtctccccaagtggtttgttgaagttttggataattagaagtatttcttacagaagtaaatatttcagtaaacattgtttcattcaaactctcaaaatataaaatacaaagaaatgttattctctatttatttttataaagattatagtctttaactcttcttagttcatttgaactaaatcaatgaatttgtcaacagaacaaaccttaccagtggctttagaggaagagcaagaaaggtgcaaaagaagtgaaaagaagcaatcacaggtatatgaaaatttaagttcttgtttaatattaggttttttttttttgctttactaacaaagcatagtccaaatgacatgacctttcagactatacctttagaatccaatagatcataattttatatgtaatttttaaaacatcttaatcagttatgaaacttaagatattcttactatctctagtaactattagttattctagtaattcttagtatctctagtaactcatagctgtctttacccttggaattgaggcaagaaattttcagaattatcttgctgttttatttatataaccttactcataatacacaaggtaacatgaagtattgggtcatattactgaggaatagaaattatgaacagtttaacaacaatggccactgagttaaactagtgttaaaggagtcatcattgccagtgcttcaaatgttgcagttttatatttctggacaccagtgccgaggttaaagatttattctgttttgtggtcaccagttgacttctgtgtctgtgttcagggagtgaatggggtcataaaagtcaatgcagttgcctattaagagaatcctaccttgcagaatgggatctttggtgtcagggtgtgaacaataactttatttcaacataaatacatagtaaacattactaaaatttaaaaaatccaaaccctatcactaccggaacttaaaatatattagaagtggatataagcagaaattctatctagatacataacactatcatagtatatcatttgaattagaatttaaaattttgcttctctttcttattggtgttcagtttagctcttaataatttagtgtttgcctagtgctctagttaatcttcagaaataaacatgcactgtaggggctcactctttctggtatgctgaggtaaagtctttgtaagagaggaagcttttataatactacctatcatctttgaattcatttctggtagattttacacaaatgcattaagtttagtccaaacagacactgagagttcagcttgctggttcatgtttctgtcctatgttaagccaaggcaaattatttttcactttttagttacaatcctataatttaagagtagcaacacatagattaagtttcacagttaaattttaattattttctaatatttctttgtttatacttgattaaagctaattttaaaacatgcactctgacagaaaagacatctgagaaacaaaacaagcaaatttgttttccattttgcacctgccctccaccaaaaaaagtctcaagaatcagaactgggtaagaacagtgataaggggaatcaatctatatattcatgactttctttaaaattcattacaaacaagttcaagctgaatattggtaaaagttctgaaaactccaaaattactgcttgccctgaggaagagctcctacatggtaactctaaagagggatgaacaaaaaaggagtgccctctagtctgatgaatcatgtccctgattttgaggagaaaaatgtatctggagggtctagctctgtggcagtccaggcagcgcctgaacagaggaagcccatgtcaaatgtctttttattccattcacactccaggtccctgaaatacacttaccagtcatcttctaagcttcatttaaattaaaataaatcagactataaaaatgataacaaaccagacacacagcttgtttctaacacagatgatgaaaatttttgttatgatatagaaactgaaaaagtaaggaacccagtaattatgattgaaatgaaagatgattaagagtttgacatgcaaatggaaaaatatataaacccaaataccactaattggaaattagacattaggcattggtctcagtctagagatccagaaagtctttttgatttgtggtttaccttccccaaagaaatgaagcatatgattcagatagaaagccacagtatttctgctgctacagatacttataaaaacagaaagccaacacaatgcttattccagaagccactgaatgacaatcccagtgttaataactacaaaaccatgaatcttgaattataaaatccgggttattctttgccacatagtgagagaacatcaaaaatagagctagaaacttacagcaagatatttcaaggtcactaacatagcacatgtatacatatgtaacaaacctgcacattgtgcacatgtaccagaatttaaagtataataatagtaaaaagaatgaggtaggcatgttacaagtagagttcctggctttggagaaagagaaagtccaacttcaaaaagacagaggttcacttgctgcttcttttttctctttatcaattatttgatttagtcaaattttctattcaagaaaatcccatgtgtacagttacagcggggttttctaaatgtgtaattatgtgtcaaagtagactagtcctgctatctaaacaacggttctggagaatgttctcataatgtttgttcattaatcaacctaattctcactctcagtcttccaagtggcatatgagctgggaaactaattcagccatataccatgtgaccttctgaaccagatcaacataaagaaattgctaaagaaataagttttagattctagattctttttactatagtcatttagagatgaattacatttatttaatgatagaatgggaatacaacgggagggaagcaatgactgagatgagccacaaaaacacttctagccttgagagttgcaatgaatattcccagccaaatgagtctgtttaatgtgttttcatgcatgcaagtttatctgcttagctcaaactgtttgaatttatagttccatcatggttatttctaatattttgaaaacaaatatatacttccacatattttaaaaaatcaccactccaatatttctgttgaatcagaccttacattatgttgtttaataaagtatggtaagttttggcatgtatgatttttatcatgtaagaagcataatttcttagctaaaaatttaacctttgactctttagtagaaagttgagttctgtacactgtgttctaaagatagacaaaaatctagagattttcttctttcaaagtaaaagtagatgaggcctttttccaccctctgaggtgttaaattgctttgctcaagttagacttttaatatatctgactaatttgataaatttatctggtaatttatgtaattcagtaacatggaaatgtatcatgttatttggtgccatgaaatgctagggaatgccgcctcaagagctctggatgaaacatttcatatgtcttggttggtttgactcccgttttcagtagataatatggcttaagtagataactgtaccatatgtgttccacctataaacatttgtggtaattgaatgtgaaatctgggaagcatctcgttttccagaattctgcactagaaactcagcagtttcactctgcttcttgtgttgtggcaaacaaacattggttcccatagttcagggagaactttcacttttttgatatcccaggattcaaaaaaaaaataaaaagagataaaaggcagtggggaaaagaatagctcagtgcagaaaagggaaaacttctttactgttcttgaaggcctacaaggttacttcctcttaatctggctatttcatgtaaaatccatgtggcaatgacagaagatatatgttatgcctgtgtctttttatttctctgtttctgccagtcaactagcataaacatttatatcagatagcaaagagtggatgcgaataaaagcacaaaatggagaagagtcctttttgaaattttggaaaattcttccattcactcaaacagaaatgagcagacttgacaaaaatttcaatgataaaatgatgagtatcttataattattatgtataatgataaaattaaagtaagcacaaaatatttttatcattaaaatggcgatagttaacctgaatcaagttaaaaaatcagggaaaaagttttttttattgaataaaataataattattgttcatattacttttattaaaggtcaaagaaggaaataatacaaacaaaagtgaaaaaatacaactatcagaaaatgtatgtcatagtacatcttctgctgctgctgacagattaaccaaagaaagaaagattgggaaaacgtatcctcagcaatttcccaagaaactgaaggaagagcatgataggtaagtaagcctatagcagtttttttttttttttttgagatggagtttctctcttgttacccaagctggagtgcaatggtgtgttctcacctcactgcaacctatgcatactgggttcaagtgattctcttgactcagcctccctagtagctgagattacagacatgtgccaccatgcctagctaatttcttgtatttttagtagaaatgatgtttcaccatgttatccaggcttgtctcgaactcttgacctcaggtgttctgcccacctcggcctcccaaagtgctgggtttacaggaatgagccaccgtgcctggccacctatagcagtatttctcagcagataattgtcattgtgctataaactaattcaaaatcggactaatgttcattatgattaaaaagttttatagttttaccagggatatttagccctgcctggtaatcagaaaaatgcaaattaacataaaataagatatattttgtaaagtcatgctgatattgaaaaagtaattcctaccattgaaaatgagaggaaaaaggcattctcatacactgttggtatatgaaattggtaaattatttctgaagggtaacttagtgctgtttatcaaaatttcaaataacctgacatccccttaactcaacaactccacttctgggactagatttcacaggaaaacataacttgtgtaaacatacacacacttattaagggcattaattatatattacacataatgaacaatagcttaataaatatataaaatatatgtaataagaaggtgaattggaagtattaagaaagaattagaaaaagtgtggggtaacagatgttagactctttagcctagttttagatgacaataatctgcagatatagtttgtgtgagagacatcttactctgtaaatcatttggagagacacctgcaatatttcatagagatgaaaacttatttctagtgaacttatacgcttgtcaataaatagtaactttaaaaatttagttgattgtaaatgaccttttctaatcaggtagtaattatgactgtgtgatttgaaaaggtagttttgaacttctaactatactgaattatttccagtatctttttgtataatacatactagagtgactagtaataaaaactttagcagaatattctttccttactacttttcaagtatatgcattcgtttgaagatgttgaagtgagaaattaaatatttgagaactacaaaggaaaaataatccagaacagaaattttactaggatgataaagagcatctgcagaggtagatcacaggatgatctctttattttttaacaaaatgaattttaagataaatgtctttgtctgcagatgcatcttaagacaagaaagtgaagaaaaaacaaatgttaatatgctgtacaaaaaaatagagaagaattagaaaggaaagagaaacaatataagaaagaagttgaagcaaaacaacttgaaccaactattgaatcactagagatgaaaccgaagactacaagaaatactccaaatcagataaatcaatctttggtaaaaattctatattttaaactttattttatcaatgttacttataatatcctcttgatttaatatataatattttggtctaaaacaaaccagaaatgttatctcatttttaaaaaatgaatgatgacacttacaggtacaattatttttattataaatcttggcatccacataggatattattttattacaaagagcttttgaaaacaataatatgccataatatatacttagtgataacctattgataaagattttgttcccagtaaaattgttccttgtacttcccgccatttcatattgattactgtacctaatactataaagaggaaacaaattattgcaatcacaaataatctcatgatattctaagaagagctctataaattttatcttatttaccattggtgttttgaaataaaagttttctttcgtattgatacatttacaccacagaagtaactgtgatctgtcagagaactagaagtagagtaagaagtcctggggaaaatcctgtagcttgcttatatttttaacatttctttttcaaatttgtggtaactagatgagctcatcaatgaatgtatataggagtgactagtataatgtctagatttacgatttagtaaatgtaattctttcaactgactataaaagtgttaaaagagtcaaattaaaatagaatgttatcagtgaaacagaactgtaataactctgggaaattttatctgtccaaatatgtgtgaaataaggttcttactatagggtggtgtatgggttagatatcaaagtgtaaatgcaatttttgatatattttaatttagtcaaatttgttaatgctttaatttatgcttttgagtttgttgtaattcagggaaaggcttttccaattctgaaattcttaaaaattctctggtgtgcgtgtgtgtgtgtgtgtttacttttataaattcattgactttaaataaatttctgaactttttggaacttatgctctataaagtacaaagttttgcttcaactttttctccagttggatatccacttacagtaacctttttagtatgtggatgtgcaggttattctttaacttcagaggtaatcatgatattttattgagtactagctaaaactttcttttgttttatttaggattttcataatcaggaagaaatgaaagatctgatggatgaaaattgcattttgaagacagatattgctatactccgacaggaaatatgcacaatgaaaaatgaccacctggaaaaagaaaataaatatcttaaggacgctaaaattgttaaaaaaacaaatgctgcccttgaaaagtatataaaactcaatgaggaattgataacaaaaacagcattccggtatcaacaagagcttaatgatctcaaagctgagtatacaaggctcaattccgaactgttgaaggaagaagaaagcaacaaaagactggaagctgaaattgaattatcagtctagactgactgctgctataagtaagcacagtgaaagtgtgaaaacagaaagaaacctaaaacttgcattagagtgaacacaagatgtttccttacaagtaaaaatgagttctgatatttccgaagtagaagataagaatgagtttcttactgaacaactttctaaaaagcaaattaaattcaataccttaaaagataagttccgtaagtaaagagatactctcagaaaaaagtcattggctttagaaactctccaaacgacctaagccaaacacagcagcaaataaaggaaatgaaagagatgtatgaaaatgcagaagctaaagtgaataattccactggaaagtggagctgtgtagaagagaggatatgtcaactccaacatgaaaatccgtgcattgaacagcaactagatgatgttcatcagaaagaggatcataaagagatagtaactaatatccaaagaggctttattgagagtggaaagaaagaccacatgctagaagagaaaaataagaagctaatgaatgaatgtgatcatttaaaagaaagtctctttcaatatgagagagagaaagcagaaagagtagtaagtatcaaggaagataaatgttttcaaacttttagaaagaaaatttaa

SEQ ID NO: 206 - DNA, 30347 bp, Homo sapiens
taaatgctcaaaatataaaatactgagctgagatttgcgaagagcagcagcatggatggattttatgaccagcaagtgccttacatggtcaccaatgtgagtgatcagtttgaaagttgctgtttataaacttgactccgtcgggggtggggagagggagaaaatgagaagggagggggcacgggggttgggattgcagatacttatctgctttgttgccactgtagggcgactctgcttctagaagcccagtcttcaaaatgagcttacctttcagtgatttggataaggcatagttttgtttttaagacccctttttctgattaaagtgcccaacatgagtggaagaggagatggagggcagcagcagctgctgcactcaaagtttttggctgggtttgtctgccacattgaaaagaatgaagttgagacaaatgctgacactttttgtttatatggggtgtttttgtttcttttttttttctcattttctcttttttttttttttcatttctctactctttttgctttttttttttgtgggggtggggtggggaggaggggctgtccaagagagaataaaacccactgttttaatctagcattgaaccagcctaaaaacaactttaagtgtaaatgcttcaggttgttttgatgctgagataccatgaatatatgattgataaatagtaatgtgctaagatcggcactgggaagcaactctccctgcctgcttaacataagctttcactgtcaaataagtgagaaaatgaatattagagttgatactatggacttctatttttctattcagagaagatccattagacttatgtatgcatgtctgtgtgtgtgtgtgtgcgcgcgcgtgtgcgtgtgtgtgatctgaggtttacattcttttaaaggattttatctttccctttgtagagtcagcgtgggagaaattgtaacgagaaaccaacaaatgtcaggaaaagaaaattcattaacagagatctggctcatgattcagaaggtgaggtttgattttgggctgaatccccatttttttacctacactctccaccctgctaaaagaaaaggagcacttcagtcttatcttaaaaataataaactttgaaattactgaatctaactaagactttaacttggaacgatttacataatgcggcagtttgcatgggagactattttatggtcctatcacaaagtaatgaaagaaggaaataaaaacttctcaatgacaaccttcttttaatcattgttttgtgtttaaatacctttgtccatggggcatataactcaccccattcactaagataacaatttaaaaatatccaatacagtgggacaaattcagcagctatgtacactgcttacttttttctttctcctttattacaagttaaacagtattagtgattgtttggtttcccacctcctttacactaaaaccatctactattaacagaattttcaagggtgattttgatgactaaattgtgaggtcataataccttgtttatcgaccataatgtgttcactgaatcatacttaaggcctccttaataattataatactatttgggaaattagtttgcagattctttttatgaactgttgctaggatgtcagtatgttacaaattattttagccatatgaggacattcataataaacttaatatacttagatttaattatcaaagtttagttggcaattttaattagatatactgaattctgaaacttcctcaaatcttcataccatttaaatacctccctctctccctccctaacatgaccatatagtttagaacttgatgagaacctggtgccaaagaattatctttctgacttttataaacctattaatgtagaaattttcctctaaaaacttgtatttgaagtggtttcttttagtttcgaggtattgaagttgaaaacataatactttgacagttgtaccatgtaccattatatattttatgtaagattcagaagatataaataaaatgcttttcagtctttctaatcttccccctactactattttagcaagagttaaatatatttaaggaagatttcagtgaacagacacatattcacctcagcctttttgtgaattctggtatccctgagcttatttattaagctgtttgttaaaaagaagaaaagatgattgactttattctttagttgactaaaataatttcttaaagagttgcttaataggcatgaaaagtaggcagtattattgagatatttaagttatgcctcttttttttatttttatgttgactgcgtctcttgaaattaaatttatatttaataccaatttcatgacaaatatttccatttaatgaagattaaagatttgcaaatcttatgtttatgtctttgacttgttttttagaactctttcaagatctaagtcaattacaggaaacatggcttgcagaaggtaaggcaaaatttgctttaaaaggggggaaagcaactctagaaggagaaagaaaagaagtcctgaacttgctgtcttaatattcagcccaattaattgagctctaaaagagccacctcatgtgtcatgcatacattagagcctctgatgagtttgtctttggggactctggggctgtactacccagtgtcatcacaaattaccaggagaaattgcttccagctcacaatcacatctgcttttggcaagaactaatgcaccaagacttcaagttctaagcctctgttcagattttaattgcaattgatcaggtttatattattgtacctccagagacctcctagagccagaacccggctggcttgctgtttcctttagagcagcgcatatcattatttggtgttctggtggaggacttttctgatggcagaaattagtttctctgggttcatcaggacgggatgcttcaagatttaagtgcaagtgtcttctttccaccttgttcacaacacagaacgttaggtgtgtatctaatgcttaggaaatctatgggtttaaaataaatgggagatatgaggattttaaaaatgttttccatgtgttactattcatgttatgtttgctgaaattgacctttgctattttgtcagttttattaggatttatttaatagagcaaggatacatttaaaggcattactttcattttgaattattttttgttaaaattttgtggtgcaatctgttatatcttttatcgtatgcaactttataggaaaatgagattgcttcataaagctttatacaacttcaaaaatgcctaatgttgagggacttctgttggcattcataatttgaaatttttcttttggatttggcatacaaatgtgaaacattaattttatggtgtggtttgtgggaaatacaaagagaaaaattatagatatttaagcattgagtgtataacagtattatttgtgtgttcacattatatgggaaacatgcaaattttggaacagattttaagatggttaaaaaggagagagtgggtctctttaaatggaacccaggtgttactgtagctactttgaggcagactgacgtgttttatcggtggtcttgaatgcagttgatcaagttgctgttagcatgtaaaataagtttctttgttttgctgatagtctagttctccaaagagctttttcaatctttatcaatctttaaagttaaatagctttcctaatagtcctttgaaaggatgattgtatttatatgttaatgaaggtaagacttactgaaagttttggctatatttaaggatcattttgctagtctgtgtaaatgaaacttactgcaatacattactttttattgcaacataagtcatattcagatacaagtttttcaaggaaaatttgcatggagattcttgtattaacttatgcctattagttttgcaaagtcaaaggttgtgagaacattacctttatgagagaatttatttgcttctccaaaataacttaaaatatctattttaattgttctggaaggtttgttggttcttagatgtttaaatctcattgattccaagtcagtgcacttgctggcagattttgaatgtgcatagcaactctgttcctggaattttaaaatgtggaatctgtgacagactcttaccattttataatcagtttcagtactttttttttaacttttgacttacttgttttgtgtcttgtagctcagataagtgattgcaataatttatccaaatttatcttttaaaactctgcagagaatagtctttctccgggattattaacatacctgtaaatcaaacctgaagatttagcactacaaaaaataatcctagaaaatgatcagtgtatttggaagaacatggacctttacttagaaaagaattataatttcaattaagttcaggaattaatcatgagtgttttatatgaattcccaggtggactactatttacaaactatggataagatttcattttagaataatttaagcgttttcaaaacagtttacgttaatttatctaatcacgatgtaagtaaaaagttgttaacgtgatgtttaaaacctaatagtgagaaaagagatctttttaacttcttgtttctagactccactttttttttgttttgagaaattaaatatattattttgcactgatattttaacttgacttatcccacctcttgaacggtattagctaagaagagatccccaaattaccctagtttatttgtagtgagatgtgtccatttatgtctttctggacatccagaaattaaaacattgccaaattggcagaccatgaaccgtttacatatttcttttcataatgctccatagccaagaaagtgaccatggaattttaagacatcttgacccttttaaaaaagatcattggcagttaatcaagtttctcgcatgagttagaattccactgggaagttaaacaggtctaaaaaccttattagacataagagtcaagttagttgtcatatgtcatatgataattgtgtttttgaaaaattataaaagtcctcaaatatttgtgaaatgatatcttagcatgtttagtttttttttttctgtaagactattcataaattttaccccaaatgcaacatatggattagtcatgggtaattattatggattataaaatttcttttatttctaaggggaagttggaatagataaggcaggactgtttgagggttgggatgggaccagtattttcagttcagtaaagtcctctgtaaaaatatacttgcattctaccaagaaagttaattcccatacagagatttaaatatgttggtggagaatataactttacattaatatcatttcccaagaaataacactgcaatttaaaggttttttttttaacatctaaacacagtttaaaacaattatcttattctgaagaaaactgcaaagttaatgttttcagtaaccacagtagttaaaaaaaaaaaaagtcagggaatatgccaattttaaaatgttgccatagtcactttatgttataattttactatgtgcaattctttattgattctttgtcttttaaattagactgctactgacagaaaggcaattgcaattatttgatcccatgaaataatgagtttaaatatcaattctatcaacatcatggtgatgtcttattcttaacaacctgaaagtcatagttaaaatggaacctcttgtgtatccagaacaaaaatagaaagatgtaaaaaattaagacaggattgtattcttccaaatttgcttcttaaagctcacctactaacacaacttaaagggaaataataattttcagtatatatctgatgtaaatgtgtagctgctctcttgactgttattttgtttccggtctagatgttctttcaggttcactttcatcaacaatattctctgtcttcagggtaaaatgttttccagtggttttgtattgagtcaagtttagtgctgcctccacacttcgagtaggagttttatctgcaagaacaacctttctacagcaaagcttattacatcatacgaataagggttttttccttttggttttatgtgaccttcaaacaacagtcaggtcaacttaaaagcagagatgtcattactttcccctcaattcgctttaatggctgatggtaaatttatattcaaaatcataagtaatatgtgctattgttacttactatgtgtaatgtcatccacaatatacagtagtcataatacactcatttttatttttcagaaatcctacttttttttaatggaacataaaattggttatgtgctcatgaattattttcccccacttggtgcaataaggattaaaggctttaaaaacgacattattttatgtggtttacataaaacatgaatttagaattaagcattgaattacagaactccatataatctcttataattgaacaacaataatttcatgtgtgtgtgggcggggagaggatgggctatcacccctctttttgatgtgctagaaaataatctaaaatatgagagaaagacttcccatttgagtttgacttaaagacagcagataaagtatattttatttctaaacattcattggaattgcataaatgttttttcatccatgttttatttacaaaatagaaattttttttaaaaatagaaaaataggatttggtgtagtatagtgtagtttttccagaggatcctaataaataaaatattgctaagcttttctatttcagttataggaaatgtgcagtttgttacattttgtagtataactttattccctttgatttgtgtataatgttataataaaaaataataatagagtcagacctctgtagcattagagaaaatatttggctagaaacaacggctagttggctctgagcttcccttaagttttcaagttactgcaggtcagttttagttaggaattgaagctgatttgacacaacgactaaaactttactgttacagtaagaatatagaaatatggaaataatgccttgatcaagtattaaaggtgttttgtcattggaaagttgcctcctttttgtatgtttaaatatgtttatacttctgcataattaatgcttttacatttgtacaatcattttaatgttaaaagtggatgtggtataaaaccaagcttagtggactcatgattattttgttccatggcctgtagcttcaatttaggattaaacagcataccactgtaggaaggtggatttttctttttttacttcttatttgaaataaaatttaaatttctcatgagaaatttgtttctaactctttgattcaaagagaaatgctacaaagttcagcaaacaatctacagtattcttatgataaaaatagttggataatagaaaagaaaaataaggcatttccgtaatggtttttcttttccctttcttgaaaccttctttgcatctttctgtcttttccttttttcttccttagttttatacatgcaagtttctgtaacaagttactctgtaaagcaggatgcatgtatgtatttgtgtgtgtgtatatatatatatgtatgtatgtatgtatgtatgtatgtatgtaactttgtaaacgtcatttatttaaatgtgttcctttaatggatctgagctctgagacagagcaataaaattggtgtgtttatattgcaagtccaagtttacttgctttagctccctggaagggtgtgacatgaaaagattgtggttgggccacatggctcatatgctggactgtgtttttgtgaatggaggcagaactccagttctgcctgcttgtcttgaggaattgctgaggagatcagctgtctcattcacgggcagaaagaatgactcatacatcttccgccttgtttggctccaggtcattgttacagtggatagaactggttttaattaaatattaaccccttttatacttgacgtttgttttatttgtaattcttccactttttccttagctttaaaaaaaaacccaacaggcacatagtttgtaagaataggagggttttcgcttccctgcagccaaccttggaaactttttcatcgcttactttttcttaagtaatgattattatttcatttgaaagttaaaaataagcataacataaaggcaagctatatttaaaattacccatctctaaggcaatattagttaagaaaagtattaaaattaaaaaggagaattggtgagtttgtgacatataggtcatgattaatatttttatgaatttctttctgataatatgcattgatacgtagcaaaaagacagaaaacagtaaaacaactttggataataatctaggtaaaacaaatagctgagagtgcagatactgcccttttaaagccgacatcctgagacttgatggcaactggtctattaacgtgcaatgaactgatagagccgctccagctattaccaataaaatccacatgcttaatctccttgaaagcattttattggtcttttggtatatactttctccccttctcctttcctcctcttccccttcgtctttaattacatagtgtggggaaacattttcattccccaaaggtgattatatccagcacagtttataatagatagtagtggaaaaaacattgcttttttaggctgacctctattgttaattttcaactttggagttggtatggcttgctgcaagttttcaggcagctgcagtttgctccttcacagtattcccctgaattgaagaaaaaaggaaatgtatgatacaagtgtggcaatactttgtcatattttccttgcctagatccaacttgtgtttttagttaactgctttccgtttactctaacttgaaattagaggtatacttaagcctttgtctatttaagtagcatgctgcttcgtttggtctattcagtttcttaagattagcttctgtgaaaatgtgagtcatatgttttttgttaaaattctgtaatatgttcaggaataagtgtgaagtatttattcagtatgttaaggagttagaacagaaataggaattcttattcttactctttacagattgttatcgtgcagctattttctgtatatttgcgaggtataacttctagattattctactcctaaaatttggcccttttttcctcacacatattccagcacacatcacacacccatcagtgagtctgtgctgctcttgcagtgacatatattaggaagttgcaaatctgcttacgatgctacaaaaacaaacaaaagacctttagaacattcataccatcatattcagttacaagtatacttttgttactcaccagctatttttaacttttcctgtaaagggatattatatttttattagattcttataaatgttggctttttaaaagcccagtaattgttgtggttgatatatttgcatctcaatagttatatctgtttagctgttaattctgagggaaaaccaaaacaatgatataatgggaaaaatgtgcaggatttgaatctgtgtacttgctgttatttattaaatatatatttaaaacacttgtaatttttttgatatgaagacttacttgaaagcacacccttcgccttgtaatttatgaatcttttagaacatttttttctgcagtgtcaaaaaaatatgttgtgttaatagctgagagaatgctaatgtacagattttagctgtttcgttgcctctctagtagacttcattagaagtaaagatattaaactgagcgttgtaatgacatgtacttttttgtggatgacttgaaagacaagggttggtgggtagaggactggaaagaagaaaataaggaacatttcttgagtagctggcattgcgtttagactgtttcatttaatcctcaccaaaaaactgtattttcactagtaaactgataagtaaaattcagttctaagaggttcagaaacttaaccaaagttgcacaactagcatgtcacagaattaagatttgcagtttgctaactttgaagttgttacccacagtatcagatattggagcaatatgaagagaaaaaaattctccttgcaatataggctgatcaaataggtatcagttaaaacttgaaaaaattattaatttgtttgattttgtttggtagcgggggtagagtgcattggtaataaggttaattattggtgtacagaagagagttgttagaaaacagttgaatgtcaaactgcatacgtttttataacaggcacaattatcagattcttatgctcttcataatataacgtaaattttattcagccaaatgtctgtttttaaagaataatattaaactaataaaaagaaactttaattctgtatattgtattcttttttatataaaatttttttaaaatgtagaattcctttttatgtagatttttttcttaagccattcagttaccaacctgaagcattttcaaaagagactgtttattttaataagcattcctcatgcagaataggctcatttaagaaagttaattaacgtctatttaaatatgacttggctggataaaaaagtttcagtattacgtaacactaatgaagtaatactacctagtcaaatgacagctaaagttaattaggatgataattcattatatttttatcaaattaaaagtaacctaacttctattttttgggcgtgtgtgtgtgtgtgtgtgtttgcatgtatttatgtgtgtttgtgaaagcttattactaatattcagtttggaataggttacttcgatgtctaaatcaactgtgatgaaaacattttagaagtgaaaaatgcacttgtgttttgattgctgccaaatgcattaagtccttgctattcagtatttttccttgactaaaaataggaacgtcttttgacatgaggactgacgaactagtgatattctttttgttaatgcctagtagttgccaggaaaatattttgaatgaaaagatgacatttgtgttattgtttgttattttgttaatgtgaatataatctttgaaatataatactttattatatatgagccaaatcaaggaccattcttccatttaaaaacctttgtagcatactttggcaaaattcagtgcaagcatcttaaaatatggtgtattttgcaggacagagaacataccagcagacgtttctaaaaaagcagagagacgtgtgtgataactgcacatcacttaaaataattgtgtggttaatttaagtgggctgcttacacactggcagtgggtgaattgaaatagcttttgctctattcttgaaaaaaaactgcaggaaatggaaattctatagctttctttattttgcatctcttttatttccatctggcaggtgaaattcggagggaatacacctgccatcatcctatttctgacatatatatggttcctaggtgacatcaatgatccccttccatttctcctcctaagtagtgttgtcaataccattttaaataggagctcattggcaaataatcataggtttgatctcagcccaagaagatcttacttgacagattttacttgacattccttatgcttttggcagtttctctcttaattttttttaattttctttttcttcttcagctcaggtacctgacaatgatgagcagtttgtaccagactatcaggctgaaagttgtaagtatagtatgactcatctcttgtatttttctgtctttctggtttccttctttcttctttctctttggttggttttcacgtccagtgtcttgtcttacattgtaccagcacctttttaacttacagccataagatgatttgatttgttaggttgtgacatcagcagaaactctgttttgagcagaatgcttgaattctgtatatcggaagagaactccaaatagtaggcaaggaagactgagttgattgaaagatggtcttgttcttcatattggtaaatatctttgggaggaaatagcatgtgatccatgaacatgcacatgtttacttccagtttgccaatatgcttacagagaaatgcctggatgctgatgggaggtagagttaaaaactacttgagattagttattgtataatttataaaagattctggaccaaacattcattggcttattgtagtattgtacattcatgaattgtcacctgcttttatttaatttttagcctgaaattttctgcttcctggttgcagtagcacaaatggaagcagccattggcttctctcagggttcttccttctgcgttcctttccctaagccttgctcctgggtctgtcagagaatgcgcaaggagtgatgcatggagtactcactgtcccttaattgcagagtgagcgttttgcctgtacaaacgtggttgccttggggtttactgctgatatttataatctgccattctaccagctaactgctgctactgaccaaaggagcaaatactaaggaaaagggtataaatgccatcttaattatgaaactggcctaatgcatttttgttctgttggtgacatctaaatttgttttattttttctaatacagatacctgcattacttcaagtaacagatgttgtgggcagtgttttcagcatttatgtttgatatgttaaatttctcaggcgtagagggttgtgcaaggttttgtccagattctctaacatgttacatgtttcaactcagcttggttataaagaaattactgtggtaaaatatacataccacaaaatttaccatttcaactatttttaagtttgtagttcaatggcactaagtacattcacattgttgtacaaccttcaccactattcaacttcagaacttttttgtatcccaagctgaagttctgtacctgtaaaacaataactcccatttctctgccctcagtccctggtaaccactgttgtattagctttatttttgatccgagaagaaaactgtataatgctgtttgatgtctaaatacaggtaattgacataggctttcaagaaacttactcagcaactatatagaccttaattagacacccttagaaacactcccagaaggatgatggctaatacaagtcctccccttcttgattaaagtatgggaagagaatgtcatattgccaacatttcccttcctatgggcaattgaattcttctttctaaaagctaaacacgtcgtctgagtaaaagaattaatctcgttgatattttacatccaaagtaattggtaacaattccaatactataccaattgtcagggtaaaatgaaccacctataggtaattttttactccttttcttatttgacctcttttcagcttttcttattgaatatttagtctctttgaactcttttctgaaggtcacactggcgtgattttcttcctttatttttttttgttttttacacccttgaccactccttcttactcaactcatcttccttccctcctctttgtggacctcttctttccctagggttctgtcccgaaacctttcctttttttttttcttttcttttctttttttttttttttttgagacagagtctcaccctgttgcccaggctctagtgcagtggtgcaatcttggctcactgcaagctccacctcccgggttcacaccattctcctgcctcagccattctcctgcctcagcctcccgagtagctgggactacaggcatccgccatcactcccagctaattttttgtctttttagtagagttggggtttcactgtgttggccaggatggtctcgatctcctgacctcgtgatccgcccgccttggcctcccaaagtgctgggatcacaggtgtgagcccctttcctcttattttacatgcaccatgccagcactgtcccatagaactttctgtgatggaaatgactacacctgtgccacctgatacagtgtccactaaccacattggccattgagcacacgaaatgtggttagtgggactgaggaaatgaatttttaactttatttaattttgattattttaaatttagacatgtctggatactggctactggctactgtattggtcagcacagctttgaacagcgatgtcttccacattgttgtctccagcctggttcttccctccgaagctgtccattggacatcctcacctgatccctgctagtgtccctgtgcagattagaaaaaggcaacacctctggacttgctcccttagcccttggctgtgcattgcacaaaacaccatctacacgccaactccaatctttaacgcaacactccacagacaatttacactcagcaagtccaacagtgaaatcatgatttttcctgaccaacgttgctcttttacttctgttgcctttctaagttactggcatcaccatccaaactgaaatcctgatatttatccttagagacctcggttctttacaataaacctcaaattgctaaccaagttgttgatcctagctttcaaaaatatcttaatttcatggcctctccttcatccctatttcattgttttagttcacacacctacattctgccttgactgaacttctgagtcagccttttggttggttttcttgtcttttgattttccctctttgcaagccaccctgtgcaatagcattaacacacagctatttggccttgttacttttcttcttaaactgtctgcaggacagagtcctatttctttagctgtacggaaaattcttctacaaccgaagccttgactgtcctttcggtttaaactcttgctactccagtgccctgacttttcctttcctctgtactttagcccttctaatttttcagttatctgggcagattgagctgttttaaatctctttgcccttgcatgtgttcattttgctttaaaacttttcatttttgttttgcaatctggtgaacctcctatttcagactcagcttagatttcacctcactgaagtctttctcagccttttcttgccaccctgaccccacagagttagctggactccacagcatcttgtatattatatttattgtattatagtattttagatacatttgtgtctttgacaagattgtgaacttcttgagggtacaagaaacacgtcacattcagcatggcttacatgttataggagaacaataagtaaaattatcattgcattcatgatcaccttcttagtgcttatttcctcctaagcatcttcagagtcttaattcgtttcttaaggtagaaacatgatatgccttaaaactgcacgtatagtctcattctgggaaaacttgccgaaactatgaaagtttaaccaaatattttcagaattgtgaaggtttattttactttaattagagaatatttacagtttaacaaatatggctttgggacatgtaaataagacacacaataattttaaaaaacccataaacagaggcaaaaataagtctgaaatcgcctaatttaaaaaaaaaagtggaaggatatgttatttcaggttttcacagacatgaaggactattgtttagatcataataaccagctaattttattcttcaccgaagaaaggacaagagggaaatgatttaaaaagaagaatagggcatttgtattagatactaaagaggatttctggatgcagaagtttatcaaatattggaattgagaggttagatggtctccaaaatgcctttaagcagatgtttgattctcgtgcgtctgggtatgcttagtgggggcagagggatctatctctagaaagagaaagaaactgcatcccctctgtgtggcctgtctgtaaattctatggggatatttttaaaaatgtgagtaatcaggtttccttgcatacctcaatgaaatcagatgcttctgccttagcttttactgctttagtcctttggtaaatgaaggttaagagagtgaagagcaaaattttgctcaatactggattatagaacatgcatttgactgtaacatgtttaaatgcatgtagaataatagagatcagagcatccaaaaattgtgaaaatgagattaaatcacaacacttgagaactttctaaaaatttccctgagcattgtttgttgctgtttacaaaatattttaattggaaatgtggaatccagtgatggtatattatagattgctaacctttgaaggatgctaactttgaagcaagtataggcattaaaaataagtgaaaacagagcctgggcatggtggctcatgcctataatcctggcactttggaaggctgaagtggagaattgcttgagctcgggagttggagaccagcctgggcaacataatgagaccctgtatctatcagaaaataaaaataaaaaccaagtgaaaacaagttcctacaagtgcatgccaggaaatcgatgaaggctaagagaaacaataacatgcttttaacaaattgtttattccttagcaataaatcttttcatatctcagacactctgttggaaaaaatagaattacgttaggatgtgcttaatccagaagaaatagaagtgtatcttctcaaaaaggacaaattaaggagtatttcaaacagaggtgaaccttatgtttctgaagtggatatacatttgtatttaaacagaattttcctaaattgtttactttaagtttaattacatcaataatgttatattttcaatcttattttattctgagacagggtctcacttggttgccctggctagagtgcagtggcatgattttggctcactgcaaactctgcctccttagttcagcagtctaccctacttcagcctcccaagtagctgggactacaggcacgcaccaccatgcccggccaatttttgtattttatagagagatggggttttgcccaggctggtcttgaactcctgggcttaagtgatctgctcaagtcggcctcctgaagtgctaggattgcaggcatgagccatcatacccagccttaaatcatatattttaaatttagttatatcattttttttttctttttgagacagagtctcgctgtatcatccaggctggagtgcagtggcacgatctcggctcactgcaactcctgcctcccggattcaagtgtctcttgcctcagcctcctaggtagctgggattacaggcatgcgctaccatgcctggataatttttgtatttttagtggagacggagtttcactattgttgtccaggctagtctcaaactcctgacttcaagtgatccgcccgccttagcttcccaaagtgctgggattacaggtgtgagccactgtgcctggccgttatatcattcatctttgaaaatctaccacctttcattttgttcttcgtaacaaagttatgtgttatttttagaactagtttgtttccatttggttacattagttcatttcagtcttttctctgtagtgattcacatgatagtgactttcacatttacattttatcttcttccagagcatttccaggagtgtgcataagtcccagggttatgcaaaattcccaacagaatagatccttgtaactctactgctttgtcttacactcagtaaaacacactggaatgcaagtccattggaaaaaatgttattaaagaaataacaataaccctgactcttcactatttacaaaagtaaatcttttgcaaacttctgtactttatcagatatctgtaatacaatactagaggaccatacaaaaatcatccagacagacccttgtgtggggactcaactgtttaaaaccactaatattattacatggatggcactttaagtaaatgaaaatcataactacactttgtttctttaagaatttctggttttaagaatagcatttgggtcgggcacattggctcacgcctgtagtcccagcactttgggaggccgaggcaggcggatcacctaaggtcaggagttcgagactagcctggctaacatggcgaaaccccgtctctactaaaactacaaaattatctgggtgtggtgtcgcatgcctgtaatcccagctactcaggaggctgaggcaggagaattgcttgaacctgggaggtagaggttgccgtgagccaagatcgtgccatcgcactccagcctgggtgacagagtaagattctgtctcaaaaaataaataaataaaataaaataaataaaagaaagaatagcatttgacttttttttttcaatgaagtggaaaaaagaaatacttagattactgttacaaatctgcttctaaaaaaactgaagtcagtcaggtctgtgtagaccctgactgaataatttgtgttaacacgtacctgtccaggatcagaaaaattccatttgtggtttgttttcataatttcctgcctttttactaagttaccttcctacatcttgtttctttcaacacatacagtgagtactttataaagttgattttttattactaattttgaaaactttcttgcccgattaagtttttttgatatgattggtcaggaaaacttcatcttctttcgtttttctgactgcttttaccaaaatgagagcacacactgaaagagaaatggcatttttttggatttaagaacatgagttttttggtttgttttcaatttcaaaaagatttaaaactttttttgaggcatatttaaacatgttaccaaatagactcaaactatccatttcaagcatgactagttgcataccttctcgcccaagttagtattcctgagagttatacgatagctacctcttgatggttctgagtttcttttgggtatgctttttgtagttgctgctttgtgtgtgtgtgtgtgtgtgtgtgtgtgtgtgtgtgtgtgtgtgtgtgtgtgtgtgtgtgtgttttgagatggggtctcgctctgtcgcccaggctggagtgcagtggcgtgacctcagctcactgcaagctccgcctcccgggttcacgccattctcctgcctcggcctcccggctagctgggaccacaggcgcccgccaccacgccaggctaatttttttttttgtatttttagtagagacggggtttcactgtgttagccagtatggtctccatctcctgtcctcgtgattctcctgcctcggcctcccaaagtgctgggattacaggcgtgagccactgcgcctggcccagtttaaatattttgtcaaagcagtttatgtacagagtaggaaaaagtgcaaataaaattattccccgttcctgcaacccacaactcacagtcctctctagaagcaactgccttttagttgtcctacatactaaataatatgcttgtactgcaacttcttgttttattagttttagattttacctgttgtcctatgaagatagaaaaacattttggataggttttaattactttaatgccggtaatcagctgtctgattctacttcagtccgtattcagacctgggcatgaataaaaatcatttgggaagcttgtgcaaatgcagcttcctgtttcctatcctgtgagagcttgacattacaggcctagaactaggcttctgtatctctaaggaactgttaggtgattctgatgcaggcctttcgtggagtgcaaggttagatattttctcatatacttaattgtaaaataaagacagcagtatcagtcttttgcaattaagttgtaagatgaaccttgccattcatacccatataaaatttgttatgtgatagaggcaatcagtttctggaaaatattatttaagtaatatattgtcatcttatttttaaaatatactagggaatcaaaaagcgaaggctatataaaaatgatattttaaatatattcttattttatcatctttgctagaattatatatattttcctcttccaaagattattctctattttagctgtgagaaagtcattgctgattgtagatttcttttatactggaaccaattctagtttagaaggaacttcccaatgctgattagagagagccaaggcattgatgacccaccctgttctaggtgtgtctagtaggaattcttgtcattagatgttctactgttccactggtgcagatgtgttccatgtctgtcacaaagcccagcagccccctttccagtaaagcgaaaattttagtttggtacttgattgttttacaaggaatacattttttaaatcaaaatgaaaatccaatgaaaagtactctccatcttgcaagtaggctctcttgcaagaatttttattttagataccctcccaggaatccatcaagtccagtaaaagaaataaaatctaaatcatagaccttgggtatgtctcttaacctttacttacttatctgtaagttgacagggaaacaaatcttttaggcccagagccacattatgattttgtgccagaaggaaaagagaaaggatactagctaaatctggtgaatgcatgcttgacttgaaaagtgggttttagaaaaaaacgtaattcatgggggaataatgtaagtagaatttgctatgaaggacactttcccttataggaagtaggtgtactttcttttattggtatacttataattttctcactgtaagtatacggaatataagtattggacaggtgcagccaatacttatattctgtatacttacagtgagaaaattacattagtcttgattttagtaaagtatgctctagtagatacttttcactatttttggttttaccagtttattcttgttaaggtacatagggcaggcttaccgcccagatgaaaaccaaaaactaaaattcaaaactctacaaaactggtgcttgctcttccaaagatgaaagctaaaaatatatatattaacccaagtctttagctttttctttcctatttttcttctttaattttgtccttaatataacaatatattgtagaaattgacttttgaaatgtgctcaaaggaagttatgtcagcaaatattttttacttaccctccctataattagtcacaagttattttgaagaaagtgatctataccttctttggttgaacttgacctcatattaaataattattttgttatacaatgaatggacttgatagaaatataagccaaacaatatttattggaaaaatctaggtaaaggatgtcagtggaaaatatttgcagaaccaaatattatactttttgtccccatatttttaataaatacacatacatctatatattctgatatgtaaaaaagtaaacacaacaattattagtatttgaaactaaaataaagcagtcatgaaaataaatatatttgggggctaccacctcatagaatatgtaagtttcatgaaataagatataaagaagaaataacctgagctaaactagtacatgtggaccttcacatcgtaattgtatgcttagtgtttgttatgggtttttattggtatcatttttccactttttttaaatcataataaacatgtatttaagatgcacaatgcatatttgcttctgtctgttactgaattttttcctaatgagagttggtgctgtatcttactaggtaaaaattttggttagatgctattgtttttttaaatctaaagcactatttgcatttgacagtagctaagggtaatgttaactcaagaactccattattggcaatatatcaggaatggctagattaaaaatactgtttaaacaatgtctgattaagctttaagatcagaaaagtacctttgtgcaatggttttgtatgtaatcttttgaatcttttgtaaatctagagtttagcaaagaagtttttttggtttgttttgctgtgggtatgacattattaaactattcagagatttgtttcatagttactcctagttattgcctatatagtcctgttttgactagtttttaggtcctgttgaagaggcttgagttgtgatggaccctttaattatcttttattgtagcagaatcttgtattcacatttctgtttgcaaaattggaatgattatattttgcaaatgagatccgtatccattactgttattttttatgatttttaaatatgaataataaatcttaatgtataacagttcttattttacctatgagagtttagtttaattaatttatttattgggtacatatgctacacagttgtagtctgtacaggtgttacgtaggtttataagactctagatgtttattcattcaacaaatgtgttttgagtccctattatatgacaggctttgtcctagtcactggagatacagtggtgaaaaaagtcagaaaaatatctgctatcatggagcttatgttcttactgcatataattgataaatgaagttgtatttatcacatattgagtaatgtgaaattatatgagtgatgtgaaatctatgcataatcactgtgtattcagactctgatctattacatattgaagaaaatgtgcttaggtttcatgtaattttaggtttttttgtttgtttgtttgtttttgtttttgagacagggtctcactctgtcgcccagtctggagtgcagtggcatgatctcagctcactgcagcctcagtctcctgggctcaagtgacctcaatctcctgggctcagatgactctcccatctcagcctgagaccataggcatgcaccaccatccccagctaatttttgtatttttttgtagagatggggttttgccatgttgcccatgctggtcttgaactcctgagaccaagcaatcctcccgccttggccccctactgtgctgggattacaggtgtgagccaccacacccggacttaattttatacttattttaacaaaatgtactctgtccaaaggcaaggccactggattccctagtggatgatggctatcagtgtctgtcttaacaccttgttgacctatgctaaaattcatgttataggggactgacaagaatatctttggacttttaaaaaatgaggtactctactgttaagtattactatttacagagtattgtcctattcattgagatcatatttgttctttaagattcagatcagatgttatttttcccttgattatcttagtcagaattaacaaattttatgtgccaatacatactttacatagatcctaattttaatcctattttcattggcttgtagaggatggttcatgcccggtttatgtgtatgattcacatgtttgaggtattcattgaatactgaattgaatgaatagtttcttgggtatttagaatcttattttttaaaaaacgtattcatgcacaggtggcttgaattgtttgaaaacgagtgccaatatctgcttttatttccctctgttttatttttctttgagggctaatggaaagctgtttgcatttatgtaacattagagctaaatctcagttatcagattagggcactctaataaatattattagatactcctatctcaccacacatttctcaataatctctattaggacaaatactctgaaataacttgatattattcctgttttacatgaagagaaacccagggcataaaataatcaaatagctaaggcatgtgatgactgaaattacacagctgagaatcccatctcatggttgcttagtctatgcagatcttccctccctgatagccaatactcagactacacgtacaagcttcaaaactgtttctattctgaaaaaaaaaaatctgcgtggctaacaaagaatgtgtttcactaatagtttttgaaaattattctcatcaaggtatgatagatgaagagagaccaagagcaccttccaatagaggtttgtctcaagaaagatgttctgtgaactcatctgagcgaatagctgtgagaaaaatagatgggaggacatggtgttcgggaactattccagtccttgtctaggctgcagtgtgtgcgcttctctgcctcaaatattttctcttatttaccagaattcaagagatgtttatgataacactgtgtatttatgcgttgtttatgcacaggttttggccccagaatgtttcagacatggtgtatttttctcactggaggagaacagccgtttgggaatggaggcagtagtagtagtagcagcagcggcggaggtattagtagtagtagtaggagtattactaatgttcatggaattcccattatagtagtaaatattcatagaaatttcaaagctgcagcttgagacgataaagattaatgatatcaacacctttaatttaaagatgaaaaactgaaacccaaaaagattatcaggctcttcatgattttaaaagaaagattgtacacccttagctgtgtgttgggaaaatagcaaataagaaaaagtatgaacctggatgctttcactcattagtgatttttttctttatcagattcactataagatacttattccagtatcttattccagatactggaataagaaatacttttctcacccattttgttattcagaagggtatttttaaattctgctacatcactagcacaaatgtatatttgttggatgaaggaatgacttcaattcaatatttttatgccaggttttgtctcgtttatcaatgttaatgtatctatgcataattcttagcttagtattatgtcgatttttcacattaagtatgatcgtgatctataaaccaataccaagttctggataaattttgattagaaatatgtgcccccctttttccatttatcccccagaacttttcaacactgaatttagtcctaaaccataagatgtttttcttagaattatttccagctgcagagttaccagcaaaagttgttgtcaaatactatcaaggccaccgaacatggttaaaaatggctcatccctataaagatgtatgggtagtattgaagcaaacctctcagtagtgttagcttttcctctgaaatggtggtcctgctgtgaagtgaacttttactgctgtttggggttgtttttctccatcctcatgaacacaacagccttattatgttgatttgatttgattccctagtccttggcactggggccagaatgtcaggtgatgcagttgtctcaactcacgggtctgtagggaaagccaaatagctggatgtcattgctgtgtttctctggatgtttttgccatctgaaatctccatgttcctgtattctttcaggaaaatcaatccctgttttcctttgtgaaagctctattttcattcatagttttattgcagattaaaggctgttgcattagaaagttatcagctaatcaataaacgtcagtcatcccattttgtgataaagctgtcccattgatcaaagtggaaatgtgggcttttggcttttacatagcaatttctgaagttcggataatgtgcttatggaatatatagacctatcctcttatttataggtcttatgtagagatggacatatgaatttatgtgtacgtaatgtacatataagcaggctaatatatacaaacatctgaattttatgtaaaatataacattcttttcttagaattttggttaaattctaagaaaatgagaagtcatcagtaaacttctctctctatatatacgtataggtgtgtgtgtgcatgaagtttttttttttttgccaagattggtattaaaatgttttcaaaaaccttaatgcaaaatttcaatggttgtgaatatagtaaaacacacatgaattttgtgattacaaaattggaaaaatatgctcttattttcatattatttataatagttaagggaatagcagttttagactctttaggtttggcatctttattttggtaacatgcagcttgtcctgttggttaaattcttaccgtggctttttttcataacgaaaaataagttatgttcacaaatattcatagtgccaggcattgtgctaggtgctgtgaactgaaagatgaatacaatactagcaataatactaatcatttatatttgttcagcattttagatttcataggccattttcacatcctgtatctcatttgattctcacagttaccttgggatatagacagagtagacaaagctcatacagttttagtgtggttcctatataaggaactacattcataggtgttgaatggcagaaccaaaactcaccttgtaacattttcccttgtatgcattccagtaaaatgtacaaagttgttattcattgatttgccatgactatacaagtgaattaaagacgtaaaataagtgtttttgccacatccgtgtatacatatatatattcgtatgcttgtgtaatacaataaaagaaaaatggaaaatttatcaaaaatgatttttattcttcatggaattattctaatttataacataatgcacaaactaatacgtatatggaaagcaagggtggagtgggcaatccctgaagttccctgtttgtctatgaaaatctttatgcttgtgctttggattgtagaaatgtggttaagttctatgtatacataggtcttcagcttcaggaatcctgaatgtttgcttaacaaaataatgatgctctcaaaagagaattttaaaattggtttggactctatttggcaacacataattaggccaggaacatttgctaatgtgctgaaattaattgaatatcacattttgcgtcttgtctgatactacttttttatattatttcatgctgctgatagtgttgatgttgaagacactaaagccatatgatataaacgtgatgagatttatctatgggactgagtacattgtactgtataagagtaggacattggacctaggcctcttgagttcaagtctctactatttactagctgtgtgaccttgtacaagcaatttaagatcattgtgcctcagtttcctcttgcataaaaatgggataaatattatctcccctagggtgactaaatgagtatttatatatatacacacacacacgtgtgtgtgtgtgtgtgtgtgtacataacattgtatatgtttatgtgaaatatctaagtaatatatttggcacatggaacatactatataagcttttattctgtatatacaaaaatatatagatatatgaaatacacaaaacataacattcataatatatcacacgtgcattcatttctgatcaacttaactttttgtgtttttcttcatactcataaataatgtctacacctaccaacatgtgggctttatctactgtatctacacatactgtaaatagttgtaacaacttgaccttttgctgttgatcacactaagtagttcagtgtatatctgtaatgatactgttagaagaaactaagaagtgttgtttgttcaaatctactttgaccataggaattcaaaaacaaaaagtgttgcactggaaacattctgatacttgtaatacagaccctactataggatcagttagcatcttatgtgtaagattatgggttatgaattctggccaatcaaggacaccctaatttgtgggtctaacaaaattgcttctatcctcaatgtttttttttatttcaaagttgatgtattcattgaaagggaaaaaaagtgttgatttttcaattaagatgcaacctttacaatgtaaagcaataataattatagtgttcgctcagcctgaagaaaaaatttcactacttaaatagcaataatcaagatgagaactacattagaagggtgctaattttatgatcattgctatttaaataataaaaatgaatccacaggacccttgctgtaacactatttgcaatgaagtggtattcagctttaaaatggtcctcttgaagcccatttaaaattaatgggctgcttaaattgtgaatgaccaaagatcaccttataaaatagctacttttccaatcaatcaattattaggctatggctgggcttctacaggaccagatgtatttgacccaaagtatttcacaaatattagtgcaatcattcttatataataacagatttttctttttcttttttttcttttttttttgagatgaggtcttgctctgttttccaggctggagtgcagtggggcaatcatggctcactgcagcctcaaccacccgcgctcaagcgatctcccaactcagcctcttgagtagctgggactccggtgtgcgctaccatgcccagctatttttaaattgttattattatttgtagaaaggaggtattgctgtgttacctagcggtcttgaacttgtggacccaagtgatccttcctcacaaagtgttggcattgtaggcattagccaccactcccagcatatgataacagattcttatattttcagcccccaaggaaaatcaataacaacaacaaaacaaatcagaatttgagtttcatcaattggattctgcatgctaaatataagaaaaataggttctagtttttctctctccaaaaagaattactagcatcagagaatttggcactgaggtaaaatcttaaagtagctataagctcacatggcaacatgtgagctttggagtaggtttaaatctaagttttatagatttacaaattttataaatttataaattttatagatttatagattggagtaggtttaaatctgggtttaaatctaagttttataatttgctatttttgtgattttgaactaattaacttctttaagctgtgtaagtaaaaggggaaaataaatgggtgaatgtaatgattaaatgaggtatcttgtctgaagaatttggcacatagatgagtattgaataactcagtagctctgtagaagtcaggcagtatcaatatctacttaatttatgtactgtttttagggcagaggactttataagctatagtaacagtaatgaagattcagaatagcaatgttgataatataattaaaggaatttaagatgattgcatttgattaatttagccatgaaagagttggtttgtgatgtcattactgctgccacatactggtagcatatcttccctagacagatgtaattattcattatagattgttctctaagaggtgaacaccgtcttcctttccattgtcctccactagcaactcaaaaagaagaaatactttagatgtagcagcaaatacattacagatctgtgaaagagcctgctctttattttatgtggtaggttgtctatgcacagtactccaagtatttaacttaagaaagataaataatctatgtatggctcccaatttaaaaaaaaaaaggttccagagaatagatctttttttttttttttttttttttttttgagacagaatctcactctgttgcccaggctggagggcagtggtgttatcttggctcactgtaacctctgcctcccaggttccagccattctcctgcctcagcctcccgagtaggtgggattagaggcatgtgccaccactctggctactttttgtatttttagtagagacagggtttcacgatgcaggccaggctggtctcgaactcctgacctcaaatgatccacctgcctcggccttgcaaagtgctgggattacaggtgtgagccactgtgcccggccagaacaaaccatttttaagcaatcattttgagactcattccattttagacattatatgaattacttgcagagttataatgccaggataaagatagataggtacttaagtatctatttatatgggatataattcttatgcatgaaaatatttaaaaaacatgattcctgccttctaaaagcatactgtgaagtatggaagaaggggaagcatatgctgggactagttaaggtacagtagagtgggaagttaaaatagcacctaagagtgcaggctttggagtcctactagttaggctcagtgccccatctactacttcctattgataaccaggtaaccgtggtatgtcaattaatctcttagtacttccatttccttatctttcaaaggggctttgaagagtgaggatactatagatgtgtaaggaggataaaatagagcattcataattattaatattattactattattgtattaacgattaaaaaaatactacctgactacaaattaaatgagtggtccttacagatactaaattctatagtttttttttttttttaagcaagatcaacacagattggagtacttgagaaagacttcatgaagaaaatgaagcctgacttacaacagaatgagaaatctactcaatgaaatattagaaatgacaggaacctggagataattcacccaatatctctgtgtttgttggataataatagctaatacttgtgtaatgctcacgatgtgctagttcctcttctaaacactttataaatatcttaatgcagccaatcttcataacatccttatttagtagaaactattatctctttcttttggtgagaa

SEQ ID NO: 207 - DNA, 2161 bp, Homo sapiens
tcacaatactaaataactgccttgctgaactaatacctgaggtgttccagggatgtacatttacttttgctaattcccaggtagatgacaccgggtgaaaaatgaggttcagagaggttaagtaacttaaaagatcatgtgtctcataaatagaatagatggaaatcaaactcacatctgcctaattccaaaccttgtgttcttttagtactccctattatctttgaactaatacaaccttttagagttacgaagtgctttaatatctatgcttttataatgtttttgtgtcttgcagggatttatcaaagatgttcatgaagactcccttacagttgtttttgaaaataagtaagttatttttgttgacaaaggccttaattttagagatggcagtgccaaactttttgcttttgggtgttcctactgccagtggaaaaatgattttgcttttagggagtggggaggtttggttgtttgatcataagtctagttttgataattctttatctgtttttctgtccataattgtcacttttttcataaccctcttcgccagaacatgtatggatatgaatcagttttgcagaaatagatggcacaaattagatgataatatgcttaatatttaaaagcccagaattttcaaatgaggttgtagaaggtcttccagttgactactggtcatcagaataagtattaagccatttttaattgcctgaggggtatgcagtctaaaaatgggaaagacagcatgctgggtttggttaggaagggctataaaagagcgctgggctgcgtgcggtggctcatgcctgtaatcccagcactttgggaggccgaggcgggcagatcacttgaggtcaggagtgtgagacagcctggccaacatggtgaaaccctgtctctactaaaaaatacaaaaaaattagctagtcatggtgggggggcgcctgtaattccagctacttaggagactgaggcaggagaattgtttgaacccaggaggtggaggttgcagtgagctgagacggcgccattgcactccagcctggacgacaagagcaaaactccatctccaagagcactgtttaattgatggtcagaaaaaaactgttcagcttccacttttaagctgtttctggaattgcctgaaaagatctttgcctaacagctgcttcatgtagaaacaagtgttgagatgatttctatctttgagcagctgccatttggacagtaatggtgaaaagaaagcatccccaaatcttttacttgtcagctgctactttgcccagccttggcagatagaaacttgagggacattttatgtcatagtatacttcccagacatataaatgacctatgagaaattagagtagggaataattttttactttataatttcagcttttaaaatacaacatgaaaaatgtcagttaactgctaaattggtttaatacattcgtatttgctacagagttaaaagtaagctttttctaggttctaattataatgtatatatccactgtaggaaagataaatggaacgtgagaaaatgaaatcttttgtaattcagctattcaaaataattgctgataattttctgtatttctgtgaacatgtatactaaaaagaattacacagtttatattgttttgtaatatatgaaattgtgtttcctttattgataggtcatgtagttgtgaaactatttgaaataagttgataccactactatttattgggcagctgtccgaatcaaagttagtcatcactgtgaacttagcttatttcatttgcagaataatgtatgtattgctcttatgatgagtaatttgggagaatgtgtactgctgttaggatgagtaatttgggaggtaatgtacaattgttaacaattatgttaattatgaacttattaagagtcatacaaaatctgttctacttcagtaactaatttcttgggaaattattaatagtatgaatgttgttttccttctctttagggaaagctaaatgataaactaacttgaaaaaatatgcaacaccaggcgtagactatatatttttaagttgttaatacaccttttctaatccttcagttggcaaccagaacgccaggttccatttaatgaagttagattaccaccaccacctgata

SEQ ID NO: 208 - DNA, 79504 bp, Homo sapiens
ccacgcggtttctatgctccaagggatttatttcagtggtaggtggagcagctctgtggagcacatggctaatgataatggattgactgaccagaagcaggagaggacctagcagaagccggaggtcaagctgccccaagactgggggacagcctgggtgaagactctggacctcatgaccatgtatattccagagggggatctaaagagccccagaaattcacaaaggtgggaatggttattttcactatttcagactgacagaaattatgcatttatccagagtgacagtgcaaaggcaggctgagctgttgttgcttccattggcaggaatgagccgatcttatggactgactctggaagagcaatgttgagtgcctactttgtgccacagagggaaaacccgtttatcccaagggctttctcatctggggatgcgcagactgtaaaccaaggccccaggaaacggtttttaactaatgtggaaaaaaaaaaatgggcttgaatatccgaaacttcactttaaaaaatcagtaagataaaatttaaatgatgtgtattattttattttgagactatttgcttcatgccatcctaacatatagtaataaaatagctttggcctgacattcatcttaaagtgaattaaaaaacgtaatttaatgaaatggcacttctaagcttttagtgcagcaaattttcaaattatcttgcttaaattaaattgctgtgcttttttgctttcgatacttataagagctctgttttgtttctggtttcatcgtgttcgccctgagatgatttttttttaattgaaatgtagcattcatgcagaaaagtgcacaaattcttaagtgcactgataatgaatgttcacaaagtgaactctcctttgtaaccagcggccaggtggaaaaagaatgtcacttaaacactaggagtcccctcaggtccccatccagtcccaatacaccccagtttccatcaagggtaactgatagcatgacttctaacaagaaagattggttttatctattatgaactttatataaataaaattgaccagaagcaggagaggacctagcagatggcagaggtcaagctgccgcaagactaggggacagcctggatgtcccccagtttgcactgtcttgtgtcaatagaataacattatatttaggagattcatccatgttgttataagtagtagtttgttcattttcattgctgtgtaatactgtttaacatatcaagatgtatttagcccctctcttgtaagtggccttttgagttatttcgagtttggggctgttagagatagtactggtaggatcattcttgtgcatatcagtgggtaagcatatgtagcatttctgtaggataggctctggatggcaggatctgggatcacaggatgtgtgtgttcaatggaaactgccagttatcagtggacactcccactagcaatgtatgagagtttcagttgctctgtatccttaccagcacttcatggttttagtctttatcattttagccagtcctgtaggtgtattggtaatgcgttgtggttttaatttgcttttatttgatggctgaattagagcatctttttatatgtttattggccatttggattttctgttttgtcctctcgagtatttgtctatttctttattggattgtctgccttttccttattgatttttagagttatttgttgtatatatgtattgcaattatgttctccactctgtggcttccctttgattctgttgatgtcatttgatgaagacatttttaattttagtatagtccaaattatattttccttcgtggttaacactttttgtgttctcttttaagaaacatctttacctattacaaggtatgaaggtgttctctatgttttcttctaagagctttattattttgcctttcacatttagttctattcttcatccagaattaatttttgcatggtatacggtggaagttaagattcatttctttcatacggatacccattgtattcatttcctaggctattataacaatgtgccacaaaatgggtggcttaaaacagcagaaatttattctctcatgattctggaggctaggagtccaaaatcgaggtgtgagcagggtcatggtctctctgatgaaggctctagggaagagtccttccttgcctattcccagcttctggtggtggccaggaatccttggcattcctttcttggcagctgcattgctctgacctctgtctctgtggccacatggccgtcttccccacatgtctctgtgtagatttttttctttctttaaggacagtcactggattcagagtccatactaattcactataactcatcttaactaatcatatctgcaacaaccctatttccaaataagtcagatgctgaggtacttgggggttagaacttcatatctttttgggggacacggttcaatctatactacccagtgaacccagcatttattacttttatttttatacatttatattttatttttatacatttatgcatacttttatacatttattacttcattgtcacctttgcataagttaggtgactgtgtagctctatttttggacattctattttattctcttggtctgtttggccttgcacaaatgtcacacttttactattactctatagtgaatctttgtatctggtagaataagtcttccagccctgttcctcttgttcaggattaacttggcttttggccctttgcatttgcttataaactttagaatctgcttgtcaatttccatcagaaaaaaaagacctagtttaaaaacaaaaaaaattggtggttcagttaagatgcaattgcgaggagaattgacatataaaaatattggacttccagcccatgtacatggcccaaccctctatataggtcttctgtaatttctctcaataacgttttgtcattttcagcataaagtcttacatatcttttgttggacttattcctaggtattaggtattcttttgatggagatttgtgttgatgaaataaaaagccaagagagagaaggaaggcttctaccaggcttactacttcacattattgaggaatttttccaagtttaccaagcttagcagaactgagattcagatcaagatctccctgactccaaatcagagctgggaaaataaatcaattattactttaaaatgcaatgttagtgagataattcaaaatgtgggaggcgcaggtggataaaacaggtccttggtagggaacccctggtagatgcccttggtctccagtgttgcaacattgagaacgtgcacgtgggctggaagagatgtgagagaagactcagatactggttaggggtgggagactcgatctgagattttcagtgttcttaggactttagagttacccagaagtaccaggtaggccaggaggatggccatggaggtaggagtttgagtcctttccctcttgaaccagagctgttctgttgcacttttatctaatattttggagttgagcccttcagaatgtgtgtgtgtgtgtgtgtgtgtgtgtgtgtgtgtgtgtgtgtgtgtgtgtatctaaggttcagaactaccaataacaagaaaagaatttttttttgaaataaaatggttcccattataatggattctccaggtatgtggtgtgctagctggatatcttttggcataattgttacacatttggcatggacacacacacacacacacagttctgatactaaagaatagcttaaaaactatcagactagttattctttaacattccgttcagccccaaggttctgggattctgatattgtagccaacctaaactcaaggggctctgcacacatcattattaactttgatcttggcagcattgtgatactgtgtgtatttcatgggccttccccagagccactccagaatgtctacttggagggacttgggagtagtaatccggttggaagagagctagacgtgtccagcagctgcgcttgcatcatagcaaagcagtgtttctgttcagactgtggattgcagatcttaggaacagcttaatttaaaagggcaagtcggaagaattcaagtacactacagaacagagtttttgttttattttctttttttcctgatacatgtgatgtgatcacctgacagggactcattaccagtaagaaaagaaagacatgattattataactgtatgcttcattctcatgagtctcatagaagcagaattgttgttttttcctccagatagtcaactgattattccaatggcatttgtttcttttatttattccccaaataaactgggtactcatggccttaacgttgaaatatagtaataataatatgaaatgatatcagtactactgctgctactactactattgcctgggggttgatggggattggagatggggagctaaagccctacccccacccatccagtcatccatttgcatgactctgcccacccatgtgtgccaatgagccccaaatctttatctctccagtccagcttcagagccatggatgctgggacccctacacctggcctctagggcagctgagcatgagcttatattggtgccttgctcaacagtgagcctctgatcccctctagacctggcaatagccaatgagaagggagcagccagcttgtgaccttcctgccccctcattctgtggtcattaattcctttctgctggctgagcaccttccatgcttatctctttttctattcatctctcctcctcctcctcctcttctctctctgctgtttactcccactcaagcaaataataaaacaacaaccacaaccttgcttgagtctgccctcctgttggagtgtagccagaaggactctagcccctgcaggcaggggaagcagatgggtcagtgttgccttctcagagcacccctcccacctccctcccacccactatatccagtgaaagggaaggccacagtcagtcaaaagtaagctcagtttcctaggaaaccctgtattttctagttcccatcctcctccctggcaattgggctttgtttgtatgcttccttgtttaatggtttatttcaccatttggaactctaatttttcagacaatcaagtttgggcttgcagagaatattgtagcatggcaggttgtaggactatactatattttaaattgacagttatttttgtgcacaagcttcccagcttgtacctcatgttgcacaggatagccatgggcacagagagctttggaggggagtggaattcatgctccctgtctcccctcacccccattctttgctttcgaaaatgagactcaacaaagactcacacagcagttccttagcaagtgggccctgcaagtgtgtgttagctgtatcatcagtctatacatgctagaggaagaattggaatctcagctacaaaatgtatgtaatttggtcacagaggtgaacgaaaaaggatgaagccctttgaatgcaacagaatgactagaactgtctcctctgtgcaaggcattgggtcagacaaggtgccaatggttcgaagatacatttagcctgcattcttgccctcaaggacctggccattttccttgcagcagatagcgtgaaaagttgtacagtagaggtatatagagagtaagactaattctagtgggggaactgggcaagaacttcagggagggatttatacgagagctggcttgagggacaggttggttctgtattcttgcaggtggagatgagggcacaataagagaggaaataggacaggtgaaggctccgaggagggacaagtgagaacagcaagtgctctgagaaggcaaggcatgagggaggaggaaaaaatgaaagatacggctgatgtggtgggtttggaatgatggtggatggctttgagtgcaaagctgaaaagtttgtggaagtcattggtctttctagcagtgtcaccaagccctgagtttcctgggagctggcttaggcactgcaggggaagaagtctggtgtgccagctgctcccccagttatagaggagagagtagctcctctcatcttcattttatatacaaggatattgtctgtcttttgaggagtgttccactttgagaaaaactaaaacccattggcatatgcgtgagacccattaatttattcagtcagtcactcaacagatattaaatgcctactgcataccaggccctgtacaaggttgtactgaaagaccgttgaagatttttgaactggtcagttgcctggtagcaggggtgctgggtcttgagttaaaatcctgtctttgcctggaggcatcacgctacctgacttcaaactatactacaaggctaagtaaccaaaacagcatggtactggtaccaaaacagagatatagaccaatggaacacaacagagccctcagaaataatacgacacatctacaaccatctgatctttgaaaaacctgacagaaacaagaaatggggaaaggattccctatttaataaatggtgctgggaaaactggctagccatacgtagaaagctgaaactggatcccttcctaacaccttacagaaaaattaattcaagatgaattaaagacttacatgttagatctaaaaccataaaaaccctagaagaaaacctaggcaataccattcaggacataggcatgagcgaggacttcatgtctaaaacaccaaaagcaatggcaacaaaagccaaaattgacaaatgggatctaattaaactaaagagcttctgcacagcaaaagaaactaccatcagagcgaacaggcaacctacagaatgggagaaaatttttgcaatctactcatctgacaaagggctaatatccagaatctacaaagaactcaaataaatttacaagaaaaaatcaaacaaccccatcaacaagtgggcaaaggatatgaacagacacttctcaaaagaagacatttctgcagccaacagacacatgaaaaaatgctcatcatcactggccatcagagaaatgcaaatcaaaaccacaatgagataccatctcacaccagttagaatggcgatcattaaaaagtcaggaaagaacaggtgctggagaggatgtggagaaataggaacacttttacactgttggtaggactataaactggttcaaccattgtgaaagacagtgtggcgattcctcaaggatctagaactagaaataccatttgacccagcaatcccattactgggtatatactgggtgtatacccaaaggattataaatcatgctgctataaagatacatgcacacatattgcggcactattcacaatagcaaagagttggaaccaacccaaatgtccatcaatgatagactggatgaagaaaatgtggcacatatacaccatggaatactatgcagccataaaaaaggatgagttcatgtcctttgtagggacatggatgaagctggaaaccatcattctcagcaaactatcacaaggacaaaaaaccaaacaccgcatgttctcactcataggtgggaattgaacaatgaaaaaacttggacacaggaaggggaacatcacacaccagggcctgtcatgggttgtggggaggagagagggatagcattgggagatatacctaatgtaaatgacaagtaaatgggtgcagcacaccaacatggcgcatgtatacatatgtaacaaacctgcacgttgtgcacatgtaccctagaacttaaagtataataaaaaaataatttaaaataaaagaatgtggcacgtatacactatggaatactatgcagccataaaaaaagaatgagttcatgtcctttgtagggacatggatgaagctggaaaccatcattctcagcaaactattgcaaggacagaaaaccaaacaccacatgttcttacttacaggtgggaattgaacaatgagaacacctggacacaggaaggggaacatcacacactggggcctgtcgtggggtcgggggagggaggagggatagcattaggagatatacctatgtaaatgacgagttaatgggtgcggcacaccaacatgacacatgtgtacatatgtaacaaaccttcacgttgtgtacatgtaccctagaacttaaagtatagtaataaaaaaaaaagaaaaaaagaaaaaaaattcctgtctttgccacccactaataagaacttgggcaagtctcttggccttgatggacccgttttctccctgtaaagcatagggttgggctgctaaatccttcccagctgagacagtctgggagtgacatgagaagtgctgtaaccagagtttgtgtgtgttgggaagcggggaaaagagaggccagagtcagagagaggtggtgatggcaagaacttctgtgagtctgagtgaagcctttcatttattcattcaacaaacatttcatattcagtgccagctactgtgctaagcactgggaaaataacagtaaccaaaacaaaattcgtgccctcaaggcactatctgtagggggtggcagaggagctgggaacatgggagatagatctagagatgtagtgtgaaacttatcccatgggatgacagttgggacagtggaattgtatgtaccaggaaagagatagcaaaacagtattgagagagaacgagttctgaggagacagaacctgggaacatcctgtggagaaccaatcaatgttcttccactccttgatagaaagcacgtttcttcatcaagtcaatacaacaaacctaaccccagaaatatgctcttgtggctaagaagttaggacacaccaaagagataatgtccatttagacatccatttctccttgactctgtcacttctatgtgtgaagcagaattagaccaaagccacgtatgattttgtataatagctggtctatttggtttcctcagaaaggtctttaataagtaccagtgatacgtataaaatacgtatgggtggcttcccaagtgaactgccagtccctcaaatcttttcccagaccagctggctcttttattttttttccttttccccaagtaattggagcagatccagaaacagatttggagagcctcaagcttttccttttttacccttcagtaattacatatcacaggttgtcttccctgttagagtctgaagctgagcaattagtctcccattgtctttgcaggaaatgacatatcagtgtggcttctggggagggcaactgttgaccatcctggttaaaataatttggaaagtgttcagcatttcctccagttgatcgtttagactggctgatttagaaagctgttggaaatgtgcaaatgtaccatggttatcaggactggaaatactatggggtcagttccctgagcaaaacgagtttctcaactatggctttgatctctggacctactgccttgtccctcatatgattgagcccagggccttggcattctgttctttttataatgctttgttggagactgattagtcaggatgttttccagctgcaggtaattgaaaacccaagtcaaggagtcctaaacaagaagacatttcttggaaatacagagatgccacagacttcaacgccaacctaatgcagtaacctacactctgcttccctgtgtttgttctgtctctggaccagctttatccttatactgaaacaaaatagctgtggaagttctaggtggcgcattccacactacattcagaaggagggagcttctcccaaaggagtgagtagaagctcccagaaaaacattcttcacatctcattggcttaaattgggccacatgcttattcttaaaccaatcactggcagtaggaatgggtatctcttggatcgatgcttctcaaacttcagtgtgcacacagatcacctggggaaactttcaaaatcaattctgattcagttggcttgggtgaggcctcagctgacagctcttacaagctcctggttgatgcgaatgttgcaggtcagcacactgcaaaaccttggactgtcccgcccccactcccagctgggcgtgctgccatgtgcccatgagcactgtgggtgcagaaatatgggggctcttttgggaagaagaaagagggaatgaccacatgcagatgagaactatattagagatgcttgttttcagtgtgtaattagcattttaactttataccgggagtcatacaatagtctgtgatatgtattaaaagcagaattgttacgtgggagcactcacgaaaatttcattcatttatggtgatgcaggcgttgcagctcttgaaacaaaagattaaacagtcatgccacccgttttgttatcattcagctatttttattggtaatgaataccatatatctggtgtgtctcaaaaagaacaaactcaaatgaaatggattgaaatagccttaagtataaaaagagtgtgccaaatccagcctttgttctgtgagtggaaatctcatcagtcatggttattggggagggagagtacacccccacttgtcctaagagtcacttgtcatgatattgggtatgaaaaatgctgccaatggtgaatttctgccaaagcaaatggtcacaatgcccttataagtggttttcagtggagaaagtcattatgctctattcgtttgaaaaggaagaactgttctgttattttgttgtgcttgacaaaagatacacaggattcctgagctgcagctgttcaggaaaaaggctgataagatggagggaccagtgtccacgctgaggctggacaatcacaggctcagcgtgcttagcatgaagtatgtggacaagcactgagtagaccttcccaagatagtcactgtggtagttgctgtcctggacctcatgtgcaaagacaacatcacccaggaggggacatggaatttcactgctcagtctatttgtcccacctgcctcagaaccaccggttcacatctgtgagactgatgggaagctggagcttggtgtggtctcttgtagaggccagagcaactgtacctggcctcaccagcatggatcaccaaagtgcccatacttaggaaatcacaagttgtgtcttgtctattcaaaggacctgaaaggttgagagagtatctgctactctgggctagctggggaaagctgctagacttgaagccccaggaaggcaggcattatgcttgtgtcacacaggcgccctctatattgacagaatgattgaacagctagtctgttcccaggtgatctgtcagtcaacagcatggactaatcactcactctcaaaagagaagtattaaacaagacaacattgtgttgcctaacttcagtaatttatagtctaaatatagaatgcttaggtgtcccatctacatgtttaggacctcataggctgcgaaggagcaatgagataatattaatgattacctgagctcatgtaggacaagcagattgcaccattacccgtggatggactcagcagtcctgatgagcgcctccctgctgtgctgtgataaggcgaggcattattaactgtggaaggagttttaaaatagggaagaagataggaccttccctgacaacttaaaaggctgactttaaaagtagtacatttatttaaagtacctatatcaaataaagtacttttaaaaagagaaaaataaagaggcataagataatactgctttgggaaaatcaaggtggaaaagtcaatgagaatgaagctaggcctgaaagctgggtccatgcatgtaattcagggggccgatgaagttggatggggaaaaacatgatctcatcattgtctctaacccttatctgaaatcgtacatttcctaatattatgaaagtagcattagctatttgtccttaatagaaattatgaatattttcatagttatagatattctgaagtatcatttatgcctaatagtacttcaaaattacagtatattagacttgttggaaattatttaagtattgaaagatgttcataacaattttgtcaaatattttgataactgtataagagtatactctgtttgactcctgtgcatttcatgtattagtttcaagcatttgtaaacatcattctgagaaagatgtctttagactgccatagcacaaaaggtaaagagcccctgcccttgacaatggccaggcctcctaccagaggagggatggcctgcctagaggctcagaggccggacaggcctctgggcgttacagcatttgataggataatgtcgaaaagctggggtgagcttgagtgccaggctaacatgactcgacaggtaaattcgcaggtcataggaagtggtggaaggtgcatccgttgaggaaagacaggctgtgtaggttgtgtttagaaaggattccttgtgcagccatgagagttggatgggaagggaagaaactggaggccaagagaccagtgtatgccaggcatgatgctgaccagatggagtgtaacgatgagaatagggagaagcaatgtgttcccagcaccactgtgaaattcttgcggggctggactgggccaaggtttgcagtggaggtgaagaaggcggtgttagtttacaggcccgagggactgggagaatgatgataacagctcaggcttactgagtgtttactgtgtgccagaggctgttataagcccttctatgtcgtgtatgttctttagttgatatcatttaatcctcatagcaaccctatgaggtcagtacagtaatccctattttacacataataaagcctagaaaagaaaggttaggaaaactgtccagggtctcacagctagctggcaagaagggaggatattactggaaagaaagaaaagaggaattggtttgggggaatatgttgtgagttcaactgcagatatttttccattgttctcttgtcttcaaatatttcaaagggctaaacattcagatatttataagcatagtttctggtatatttcattgtccagttttaaaattttttattagtgaatactgagataatttgtaaattggtttcatcttcctgggaaaaacagaggaaactggtaggtggaatttagtacatcgatgggtgcccgaagcagaggaagaggttgcagtttacagagagaaacataatatgtgttcaattatttctgtttaatgatgtggtttttcttttgttgtggtattgtttttcaggaccagtcctgcctctgttgtagaagacatgtggtgtatataaagtttgtgatcgttggcggacattttggtaagtgttgctgcatttacttctaatgcctcttgctgtaaaagggtgctcacgaagggaagctgttgccttgttctgtccatcttttacttctgcactaaactcaggcagaatggagttctataattaaatgtgacattgaattgatgttttctgacagtgtgatactttttcttgttattgctgatagtattaagcaatatggggttttctaaaacgtaataagtgtatatttagaaaagtttccggatgccggttaaagaatacccttggcagtttatgtgctaagccagccatataatataagagtaataaacttgcagacccaaagaataaaataaattctccaaagcagagagatccgtgtgacccatatattaaaagaaagagaagcaggcagcttaggaaatggaaaattaaaggaagctacaagtccagcttgcctgggagccagcccacagaccagcataacagtggtcttgggagaccaagaacgttcaattcagcaaccacccagaccttgctagcagggaaagaggacagtctttgggatcaggagacccgggttaaaatgtaagttctatacctactggttgttagataacctctctgagcctgtttcttcttctgtaaaatgaggcttatcatgttacctacatcatagggttgttgtgagaataaaatgaggtaggtagtgctggagcatagtaagtgttcaataaagccagtcattcttaggaacagagcagccttgtttggagactagacatttcccattgaagtcaggctaccaagaggcatatttattttccagcaggaaggcagctggggatgggccggttacatccatttgatgttgctagagcatcccagctactcaccacaacccctcctccaatattcacttcataagaacctgtgggaatccctgcaacatttaccaccttctccaaccctggtgacccattcttagacaagcttggctaaataattcccttcctgccatcctcacaaccagtgaggtcaccttgtttgagctgtgttcatttttggagttaatgtcattttgaatcacatttatgaggaaagaagggtgggggtagatgataccattggttggacttcagttgccatatttaaactttcatttccaaacctttcttttgattttacgtttttgtctatgcttattacgtagccttcacagggatccaattgctgggctgaaatttttgagctttgactgaaagaatttggcttttgggtggggcctttacctgtggttgggaaactcagccgtggcattgcagatgggccagtgtttaaggtcagatgtctgtaggtgactgtgctgccatttcatagaatcaaagagagggacatggcttcaagggttgtctggcccaatcccctgctagcaaaaaaaaaaaaaaaaaaaaaaaaatgtctcctactgatccctgacaagggaattcaaattcttccagagatgaggagcttgctgttgcacagggtaccttggttcaattaaaaggacagttagggcctacagggaaacccttgtgaggagggggtatatagttgttctgtatcttagtgctggtggtatttatgcagttgtatgctttggtgaaaactcacagaactgtataatagaaagggtgagttctcttgaatgttaattagacctgaattttaaaaatggaaagaaaaaaaaccccagcatttaaaaattgaacaattagcccaacttgttaaaaagaaagtaaggaggctgggtgcggtgactcacgcctgcaatcccagcactttaggaggctgaggcgggcagctcacagggtcaggagatcgagaccatcctggccaacatgataaaaccccatctctactaaaaataggaacccaggaggcagaggttgcagtaagccaagactacgccacttcactccagcctgggtgacacagcgagacgccatctaaaaaaaaaacaaaaacaaaagaaagaaagaaaaaagaaaaaaagaaagtgaggaatacaaaggagagagggaggagggaggaaagaaaagcaatctagtccttatattgaactattaatacagtatatgtgctccatgggacagggacttggtcttgttcctccctggagtcttggtgcctggatagtgcctgtcacatagaaggcataaatgtgttaagtatttattgaatcacctattgctcttagtcaccttcgaagtaagtccactcactttctaacactccagcccaccaaatgtttgaagacactgtccttcctcattcatcttttcttctctgggtgaatttaccatctcccgggcctggcctctttgtcctctgatgctattttcatatccctccccatctggcagagctccttgaggaggcctctacttccccacacctctcctgtgcacctaggccagcattagacacgctgccccacaggtctggcccacgaggagcacagagggtgcattgcttctgtggatgctgttaatagacacccaatcctcttccttcacaatcagtatgaagtgtctggtcatggatcataaaggatttatttagtgcagtcttctaagaaaggagctcctaaaagtagggagggtggcagtgcaagaaagagcccaggcgcagctcatcctcttacaggccttgtctgaaatgaagccaggtcctggcaccctcagtctgaggcagcatggtgctgttgatggatctttagaggcagtgctgtgtcacagattccgatttttcattacaagtcataggaagtttgaaattcttcaaactaaacttgtgggtgccttgaaaagcctaggtttcttttttctggccatgccaaggaatgatatataaacacgtaaatacatagagcagtggttttcaactggggttagttttgccctcccagaggacatttggtaatatctgaagccattttgggttgtcacagttaggggagggaggagggtgtgtgctagtggcatctagtgggtggaagccagagatgctgccaaatgtcttgaaatatatcgtagatcagtaacgcacactcgtgcacacatgcagaataatcgggcccgaaatctcagtaataccaagctgagaaactctgagattataagtaatttttaaagtgtaaatatttataaagtacttattattttgaaggtttaaaaatggaaatatcttaacatttgatttatgtaaatatacagctaaaaaacttaaattcgttcagaaaatcatcagagtggaaaggctgctaagaggctatcccttctattacccctaactccaagcgaaaaatgacctaaatgaattcagacagacagatgggcctctgacggcttatacagaatgacggtcaactaaagataaaaacaagactcacacaacatgatcccagcatttacacaaagagattgtctcgtattttaaattttaaccccagcttcttcagatgtgttagtcatttgatgacctctaagattaaacggtatttcagtctgggctagtctttctttttgaatcaaggcggttctggtgtgatgaaaatgtgcttagggaggagagagatctcattacagatgattgagattgagtattttggtacacagagctgtttatttgcatcagtttgctagtgacaccacaatctggtttacatgtgagtcgctgagagcttttgtagcctaatatggctacatttgctgaagcagggagattaaagcaacatatgtcaatttatgatataggacaacccactgcaaaagactttacctaattatagggcctattttgggagggtaatggtgctttttgtgaagtatattttgggatgcactcacccggcttctaggccagtaatatcttcccagaaagggtgtggtgtgtgcttgtggacataaatattttcttaccaaaagctgtggtgtaatattctctcaactttactacccttcatttttctttttctgatagtcttttcttttgcaagaatgctatgaaaatgtattctggaaagccagagaaatggaagataaaagatctcatttcagatggccaagtccagagataacagagattttatcagtctactgtttttaagatgaatgggatttggaggcattcagcaacactgactaataaacagagttgagggaggtgataaaaacaccgtgttggcactagatatttttatgtaagtatctgtgggaaaactatccatttgcaaccccttgtgtcccagccagcactgcccctgctccactccaacccctgggtgatcctcaggggccatttccatgcctttgctgttggcttgtgacccagggtaggtatctgcttttacttttgttctttaagactgtgcctttcacccactctacctattaacttctctgttaatacctgagacttttggccttcaaggagaggtcagaacttgctgtctggtctgcaaaataaaattagcttcttatttacacaatgtgtgtacagggggaggagaagctgagatgaagagtgaaaatggacaattttgtaacccaaaatccaaccagacctaggggctggagaaatgcttttacctaaattctgagtcatgaaggccataacatgagagcaagaatatcccatggggagagttaaaggcggagaatcccaccagagagccctctggagaggtgtccctgagactccctgagcagcctgtgggccccttcctcagaactggcctaagagctcattaaacgcacagatcctggcctaccccagactggtagaatcagacagaatccctgtggtgggtgtgtgactttattcttaacagcctctccaggcggtgcttatgcacacgaaattgtgagaatccctgttccagtctccattctcagcttttcttcagggcttacagttccatttgaggttgtatgcagcagtctggccccgcctttaagactgattcccttccataagcgtcacttacatatttaaagaacagatccctaaagcacatcattttgaaaatcagccctgtgcataggagggtagggtgtcaacttctgtgttactgtgtaaccttggttcttaaagtaatttccacagtcattgtatcacttgctcactaagaaaagtatcattttcgttccaggttagttctggcaacattctaaaccagattccttgaagttgctttgcgggaggccatcctgctcctctgctacaatcacccaagtatttgccatctgctttcactctaaaattcacactatgctgtagtttttatctgtagcaacacttataaaccaaaatttcccacttattaaggggaacattttcagaacaagtagctgtcacatattctagtgcatgactagagagataagactgtaatagttcccacctgggatccaggtggttggtcccaccccacagcctttcctctgatggcaggctgcttgtgcagatgcatattagggtatcgtaggcatagctcatttaagtttgtaaacagctagctgggtgcagtggcgcatacctgtaatcccagcactttgggaggctaaggcaggtgggtcacttgaggtcaggagttcgagtccagcctggccaacatggcgaaaccccatctctactaaaaatgcaaaagttagccggatgtggtggcacacgcctataattccagctactcaggaggctgaggcaggagagtcacttgaacctgggaggtggaggttgcagtgaggcgagatcacgtcactgcactccagcctgggtgacagagtgagactgcatctcaaaaattaaggggactccatccccttaataagtagggggggaaaaagctgcagcacatttgatcttcccaaaccacttcctaggcagtgcaatgttatcaccagttggaggctcagataatttagctgatgtctaaggcaggaggcatttgggagtgtgtgggggggatggggaggggtttgttgttgtcctcacaaagactgggaggtgccattggcacatgatgcaagagaaagtggggcagggatggtaaatgtcctgcagtgccttgaacagtcctgcccagtgaagagctgtccctaacacagtgttcatagcacccctatggagaaacactgctctgaggttgtactagaatgcagtagagccaggtgcacacccgcactatctgaatccagatcctttatagccctctctgtgttaaaggcatcacagaattaatttccacttcattgggagctctcagtccctgaaagttgaatccagagtggctattctgcaggtcatgcgattgctgccccaggcatcagaactcaggcatggcccactccatatggaaacaggctctctaaaaccccagtggcctggctagccagcatgttatattgtacctgtcctatctctatcagtgtccagtgcaggtgtgagagagagtactgtctttggaaaagatgagagcccagtaggatgctcggcccacagcctcgcatccacctgacttaaaaaccatcgtgatagcaaattgggtgttgatttcagaagtttttgatttgttatcttaaacgtcatacctatctggtgaacccttacaggagctgttggagttttgtttaaagtttagttttgatgtcagccagtaagggagctgagacagtggctacatcagtttgatgagcacacaatgaaatttattaaattggtaaaaataaaaccatattgaatgaaaaggaacccagggcaactgacctgaatatagatgttgaagggattctaaaagagggagagaaggagtagtgatattatctcatctttttttcctttcctgttttgtatttctccctctccctctccttttccctcttcccctctccctccccctccccctctcctttccccctctctccctccccctctctccctttccctttccctccccctccccctctccctctccctcctctgcgtctccctctccctctccctctccccctctctctcacccgctctccctcccccgctctccctctccctctccctctcgttttccctttcccactctctccctctccctctctccctttccctctccctctcccgctcactctaccccctccctccctccctccccctccccccctcctcctctgcctctccctctccctttccctctccctctccctttccctctccctccccctcccctctttccctccctccctctctttctctcccagtttctttcccaactttttattttggaaaatttcaaacttgctggttgggagaattataaaacaaatttcaaacttgctggttgggagaattgtaaaacaaacactttatgtcctctgcctaaattcaccatttgttctacatttgcagcatttgctttattccctcttctaattatatatataaattatacatattatataaaattttgctgaaccatttaaaagtaccaaacatcttgacactttacctctaaatatttcaccacccgtcccctaagaataaggacattcttttatataaccatactatagtactatttccacatcttaaaaatttaataataattttatattatctaatattcaattcatattcaaatttcaacaatacagtcccaaataatattttataacttacctccccgcccccaccccaaaatctgtaactgatcaaatacacttgatgaatttggttgataacttttccttcattcattatataactttaaacaatgactttttgaaaagttcaagttcgctgtgctatacagtgccttacactctgggcttgtctgcttcttcacagcattgtttagcatgctcttctcttcctaaaattggttagatctagaggcttgttattaagtggaggttaaacatcttttgccaagaatactttataaatgatgtcatgcacctgatattatatcacatcagggagcagaagaagtcaccttgttccaccatcctcagtgctaggtttcatctcttgggtaagatggtaaccagacctaaccaatgtcaaggtgcaccttgagttaataaatcatctgtagtctgatacatgggtcatttgtgaacatcctgctccagccttcctttcatccagtggcttgagtaaccatggataatcctcacctgattcagttattactttggaatattgtctgatattttttactctttcctttctcttcctgaattattcgtagtgtatgacctgggccttcatatttttgcagtgatggttttctagccatttccttgatggtcacctggattttgctgtgattaggctaaacatttttttttcttgcccttgggttaagaaggaataactttagcaaagcatttactacatgctaggtaccacacaggctcctcatgtgtagaacatttttcactttcttcccacattacagcttagactagtgaagtgacttgcccaaggtcacccagactctatgggagagtaagatcaagccatatctgtcaggtttagagctaggatttttcaacaattccatgttccctctcatcccttctggccatgccccccatccctgcccccactactacagttcttgcctcaggccacaagtgcctgcctgactgagtaggtccctaaacaaggaaagtcagccaggagactgcagctggagaagcacaagctatgcacctctaaagggcaggtactgctggacctcagacgagccatgcctgactggaaaccgggatctttatgttaaccattccgacttttcaatggcggtgactaattcagatacacggaactcaccagcccagttgccagttttcagcaccagcattactgctgtctgaggcagccttgggtaggccaaggctttgtttataaatggaatttcattgtcatttgtttgtatgtttgtttttaacatcctcttttacacagaaattaatatgcttgggaagtgatagtgttttgatttgggggatgtttgattttttgaagagggggaaagttgggtttcatagaagtgttatttaactggattacttaataggttaaggtgttattataaaatcttggattttttaattggtaggttaacattacaatagtaggtatttcatatgtaagtttaaaggaaaacaaatacatttccttctacatatcatctgtaggattttgctgttttgaatttttctgactccttaagaagggtgtgacatctgttgttcccatcttgcactctttgttctttgtgtctttaactgtgttaacatgtcacaggaactctgtcagctcagtccctgagagggactgaagcagaactaacagataaatagcagtgactctccagatgggtccaggcagaggctaaagatctctgttggtcattctacttgtttttaccagaattattcttgagtttggagtgaccgggaatggtgcaggtaaagagcttctctagacttacttcatcatgcaagaatttggtcctgcctctcattttacactttaaccgcctgaagcacagagaggttgaggaggacccaggtaaaccttgctatggtttgttcccaccaaatctcatgctgaaatttgatccccactgtggcggtgttgggaggtatttgggtcatgggcagctggatgccattcttacgatagagagttctcatgctcccaattctggattagatctcgagggaatggttagggttcttccaaagtgaggacacccctcctaggtttggcgtcttcacacatatctgccatgttttgacccagcacatggccctcctgagaagctgagcagatgccagcactatgctacttgaacttgccagcctgcagaatgatgagctaaataaacctctcatctttatgaattacccagtcacagatatataagaacacaaaataaactaggacagacctgattagcttgggtctcttgtgattgttcttcatactccctaagctaaagttttcagtctacaagcagtcaccataatgctttaccctgacctgtcaccttgtcacccacaatgtttcttcccatctgaaccaccccagcttcccaccatcagccacatttaacaagtgaagaagtaaaggtctgaatcagcactgtccaatagaaaccaaagtcaagcagcatgtacaatttaaagctatctagaagccagtttagaagaaagtagaatgaaatgagtaaaattaaactttacattttatttaacccaatatatgtccaaaatattatcatttaccatacagtcagtatgttaaattattgagatatttttgtactaagtctttgaaacttcatatgtagtttacatttacagcgtatctcaatttgtacaagccacttgaaatgtgcccagtgtggctactggctatggtgttgggcagcacagcagtacagaagacatagtccaaggtcacacccagctatgttctttaatttaaatctcaagagaaacttgatctgcttttttgccctccccccatctaaaaccacatattcctgtcctctttgtgccattctccccctctccagctaactctaattacagagagatgcttggtttggtcataactgctagctcagcagttttctaccagccctggcagctggtgagaccaacatacactgcctgtaaatgatagtgtaaagcatacttttaaacttctccacagcagagtttccataattttctttctcttagaagtaattcattggcatttttcaaagccagggtgtgtgtgtttttttttaattcattctttcttaaagtcccatcttaatcaatggattcataaaatatttactagctagtaatctccccaggaccacagcagaacaagcaggccttgtgtctgttttttataccagttatacctctgttttgattaacagtggttaggtttcttttttccaactagtcaaatagtctcccaatatgtcagtcccattttgagtattactcacaatgaaatatcagtaaaggttagattccatttccactaaatgtcaagtctctgaccactgaccccactacttgaattattagattataatcacaatctcaggggagaaaatgacaaaagaatggcgacagactcctggagtttgttgtgatagactttactaaaatacaaacccttagctgtaagaattgaaattcaaatagggaaaagattgtcccatattactaattagaggccagaaccccacatcttccaacattctcagttaagtgaaggctagaggagatcatgttttttgatatctttcagtaactgaaggatggcactgcaaagccagccctcttgtaatacaaatgaattttcttacattcccttcagtgctgtatcctttggattttgacttgatgtcaacctcactattcacagatcccctaaaatccaccatttaaaaaacttcaggtgtggggttgcatttggaattagaacagtgttgttgtgagtggcttggtttcttctctttccccaccatttccctagagtaatacacacttagagcccccaaatcacaatccttttatcccatgctgattcaaagccttttcatttctttaagtggatatctcatgttcatttcaaaatgtcatttagcagctgtatttctgctaaataaccagaaattatagttgactccagccaagtggctgagtacctagattttgtttccaagtatggtgctgagcagaaatgttttggtttcatcctcaatattaatagttgactgagagtgatggatgggcctggggatgagaaaaggaaaggaaatataaaatatagtggcagagcatcatctgcttcagggactcttgacctggggtttttaccagaattacctgagatgatattaaaaatccaggttcccaggccccactgtccctccattcattcggagtcccggagaacagggccctggcaagtgtgtaggaaccacctgctcttactcaattgtatccacttatcaatacttagggagaattttactgtatacaaattacacctcaataagcttgtcctgaaatctgtttgtacacatgcatataaatttttgaaagttttgactttccctaccatgaggagtatattgactgtcaaacgttctggagtctgaagacaaactcacagttgaaacaatcattcattcactcagtaaacatgtaaggaacagtgctgggcattgttcctagtctgggaaaacagagatacatccagacacagcatatacctcgaaggagtttgtttaatggataagaaccatatccaacaattatgccacagtgtgaaaagtatatctatagagcaaaaagggaggaatccccaacaaccacatacacgcatgtgtgcacacacacatacatgcacatattcccacttccacccccctgctttttgaaggtagaagagataggctgtgttgtgaaaattttatagaaaagccacagcacgtgattcctgaggtgtgagtaggcaaggaagtgaaaagtgtgctgcctgtttttcaaaggagtagctctcagaatttgattctaacgtcaaaaaaaagtttttacaccctcattagttttaaggggattttaacaacccctgatgtgattcagtttgcttatcctgatctatctagtcccagcacaggtctcagtgctggcacacagtaggtgccagaatagaagtgatgcttttagcagttttgtctctcttctaacaaaccattagccacaattgtatcttagagtacacacgtaattttcaagatagcacctaagggccaggcagggtgacccatgcctgtaatcccagcactttgggaggccaaggtgggtggatcacaaggtcaggagatcgagaccatcctggctgacatggtgaaaccccatctctactaaaaatacaaaaaattagctgggtgtggtggtgcatgcctgtagtcccagctactcggaggctgagacaggagaatcacttgaacccgggaggcagaggttgcagtgagctgagattgcgccactgcactccagcctgggcaacagagcgagacttcatctaaaagaaaaataaaaaaatagtgcccaagttatctttgtaagtattgcttccaaaataccaaaaatctttgcccttgaaggagagcacatttaagaaaatgtgaattattctactggcatggtatgttttgatttttatatattaagggaattaactctttcttacctgatttttactcttgtttttcaatatacctgaagttttagaagagcagctatgtcaaaagatcaaatgatcatagcatgacttactttgtcatttaaaggtagacacagaaaacagcattgtattttcctggatactgggtgatcttgttggatttggggagcagaggttatttgagagcagctgtttatattgcattaaaaatatagtcgatgttggggtggctgcttacctaggacaactatatcccctatatatttttgcagctttatgtgtaaattatgatcattggttactttgatattgtaggacacaataggagaattcccaacttgaccctttgactgtgttgtgataggaaaagacattatatgatttggctgtgtcatcacccagatctcatcttgaattgtagtttccataatccccacatgtcatgggagggacccggtgggaagtaattgaatcttaggggcagttacccccgtgctgctgttttcgtgatagtaagtgagttctcacgagatttgatggttttataaggggcttttccctctttgcttggcaattctccttcctgccatcacgtgaggaaggatgtgattgcttccccttctgccatgattgtaagtttcctgaggccttcccagccatgcttaactgtgagtcaatttaacctctgtccttcacaaattatccagtctcatgtatgtctttattagcagtgtgagaatggactaatatagacagcaagagctggtttacatatggctttgtttagaaggctgaatgatatttctagaggtgccctgtgcattggaaattttttgtggttaatctgcctgctttccaaccctaaaagcaatgtacattccaggctctgttaagatagccattctgactgggaggaaaatagatgatggtgtgggaggtgagcttgaggttaaatggcaggaagggcagggcattaactttgctactgggcatgtgcttgcatctgagctccattgctgaccagctgtggggtcttgggcaagtgaccaccctgctgtgactcaactttctcatgtccaaaatggtattgttttgaggattaaaagagaagaagtgtggtgctgacatgatgcctgacactcataagtgcttactctgtgtcatgtctcttcacttttccctttttacacatatatcaatcttgtcattctcttgtttcagaacttctcaaggctcctgttattcccccaagaaaggcctaaacaccttaacctggcatctgaggccttttatgatctgtctgtccaacccacctctttaacacatctaactctttcacttcaaatgtgatcctgtagcaaaaccaaaccatctctgtgcccttggagggctttgaacactcattttctaacctcttgggatgccttcctgctgtcgcttagagtctaagtctaatctgctgcaaggatcttttttttttttttttaatttctagtcagtctctgcttatccagcaaggctcatcttaagtgtcacttcttcctagtccatcaggctagaaaattcacctctgtgtccagtactgtgtctttttcatcataggtgcttaaaaataactgaagtgttatgaataagtcttagaacatattcatagataacacacgccagagaaataggtaaaggttccttccaggtgggcatttatgtcaggggaaaggcctgggtggcttcaacaacagaatcatattttctcatagtctggagactgaaagtccaagttcatggtgcaggcagggccagggtctggtgagcctccctcctcgtcttgcagatggccactgtctctggtgtccccacatggcctttttctctctgcaagttcccctgctgtctcttccccttcctataagaagaccagccctattggatcagggccctacctctttgaacttatttttcatcaacctcctttaaggcccccttctccaaatacagttacattgggggttagggcttcaacacatgcatttgaggggacacaattcagtccatcacacataggtataaaaattcttctgatcctctgagagtgtgtgtgctcatgtgtgcacacaccctgtgtgcaggtctcctctgttacaagcattcgttcctggcctcattcaggaaacccacaggatagcaaatggccttgctcccttgcggtggcccagcttggcctgcctactctagctgcctccgcatgatcccagcccacaaagacgctgcttcggccccaccgagagggctccagacacatattttctcacccagcggttccatcagagcaccctcctgcctccagctgccagcaaaggggaacaagagagaatgagccacagcagggaagggaaggaattcaggaactagaacaggagggtgacattttgttttttaaaagagcatctttccttttacttctgtttaacattgtccatggggttttttttcttccacctttctccagattcccaattctgaaagcactaaaggaaccccttagctctacgagttaagacagttgataagtgacgtgggagaatgcactctaattaggtccttggttaacctacccctgacttaacagagggaggctgtttggttacaaatagttcttattctactaaatcagaggcttctcacgctgtgtcatctgcctgcaaattagctagaggcacaagctttgcattatgcaaagtacttattctcacaattaatatgctggaaagtgtggtttcacacttttctgccggcacaggagttctcactcaggagtgaaccagatcacctggggagcttttacaaaatacccaaggcttgtccttcctcctccccatgctgccccacagccgtgagagtgagatgtggggcccccaaccctgcaccagtaaccccagtatcactacttcttattacttcctcagaggtttcttattaaatatttcaaatcgcttttttcttttttctttctttctttttttttcttttcttttttttttttttttgcttgacaaaatccagtgaccaattttcttttttaacattttattcatttttttttatggaaaatttcaaatgtatagaaagtaaacagtgtagcctactggactccctgcaacctcacccagctccaacagtgatcatcaacattctgccattcttgcttcacctatagctggataattgttgtcattatttttgaccaattcaattttgtttcatagatagcatagcctgagcgctgaaaattggttatgtgttcctactgcatattgaattgactgtgtgcaaggcacttcccacaccttattgcatttaatctgcacagcacccataggcattgttacccacattttataacaatggaaactgaagctctaagaaattacacacctgcccaaagtctcccagctagtaagtgctcaagcaagcattcacactcatgtttgaaaagcatgcttttccccctaagctacacttcagaaaaataaaatgcatgaaaaaatgtatagttaaaagttttgtagcatgaatagatgcatagctatttgataaagcacgtatgttataatattaatgtttaaagctgggtggtaagtatatggatattcagtgtaaaattatgaaaactatgtttgaaattgttcacaataaaatgttggaaggtttccaacaaaagcaaactttgtcttaactctcaagcagtggacaagacaaacaagctattttcagatacctatcctgttgatatccgctccaaagagagagctttgagacttggttgaattttgaccttaaaaatagtaaaccttaaaaatagtaaagtgtaagccaaaaagtatctgagacaggtttcaatcaatttagaagtttattttgccaaggttaaggaacatgacccatgacatagcttcagggggtcctgaggaacaggtacccagggtggctgggttacagcttgattttatacattttatagaaacagaagttacaaagacagaaacccacacatgtaaggtatacattggtttggctagcaaggctggacatctcgaaggcagtgtgtgtccaggaggtgaaggagggggtgacttctaggtcataggtagatttaaatatttccagattgacaatcggttcaaagaattaagctttgcctgaagagttgaaatcagttgaggtaagtggggtcagggggcctgaaagataaagattcttgtcatgtggatgaaacctccaagaagaaggctttggagagcataaatgtaaatgtctcttatcaaaggagtcagagtcacagaagagacctagtaagggaaggagattctcacccgtgtccagccatttgaatgcgaggacttttttagttacctgtggtggcaggtggcagatatcacaaaaattatgcaaggactttttttttttttaagctcatcacctatcattagtatattttatgtgtggcccaaggcagttcttccagtgtggcccagggaagacaaaaggttggacacccctgcatgcagacttcccccacaagagacacagctttgcagggccatttcaaaatacatcagggaaatatatgttagggtaaaatactttgatttccttttagggcctgttatctgtcatgtgatgttatgctagtgtcaggttggagttagtatcatattgctataagagtctgttctgtcagccttagggtctctgttttaatgttcatgccagccagttgtgcctgaactccaaagggaggagggtataacaaggcatatctgacccccaccttcccttcatggcctgaactagttttccaggtttctttggatccccatggtcaagaggagggtccacttagtcacttggggggcttagaattttattatcgtttacaataaaatagacattacttagaggtataagtaatgagcattaactggtgaggtcttagggaactgagaaaaccagatgcagaagcaaagcctctcccagggtggcccccagctgtggccaacagctcaggaagcttcctcaccgctgctgctcgtggaaagccagagccagataaaatgaacaagttattttttccagttcaagccacttagataggattccatgatgatttctttttaccatttacccaaaggaacattttgcatacacacagcctacgtgttgaagctgttccttctcacggaagggcataaccaatttcttcacataaaaaacatcgagccacccacactcctccatgatgtaatgcaggtcctgctttgacggtgagctgaccagggattgctgagcagtctcagcattgggaatgatgattggatgcagatagcctgtccaggggattctcgagagcattttttttgctaaaagtacaaggagaccctgggcaagcagctagcagccccctttcacaaccctgcagagcgtcctggaggtcccagcagccactgttcttcctcctaagcttgcctgccatggcagcatccactccacccttcagtgcttgaagccaagtggttgtcgccccggaaggctctgcccttctggttttagactgctgtggaggagggagccacttggagatacaaagcccacctctctagaatcttccagggtccccacaaattataaaactatggtcacaccaggaaaccaaggcattttcaataacaacctttcctactgatttccagcttcatcttccagaattccagtgcactgccattcataccattcattaactgttctcctttcactagaccacgagcaggtatacagccacaaagaggaacccatctcatgagttaactactccatcagcttccttcaccctgaaatcttttggcagtacaggctagaaggaagaacaggctttgcaatcagacctgggaatgaatctcatcggcatcattactggctgcaagattttgggaaagtggcttaacttcttagtccagctcacaggattaatgtcaggtttggactcagataaagaatgtgaaggctccctgcctagtctctggcttgtaacaagtgccaccaagtgctagtgtcctttttctgtattatgtatgttgagttgtagatatctgctgtcaggccctgtccctgccactggctggtgatgtgaacacatcttgtgtctttgcatctctgcaccacagtttcatcatctcacaatgaactgcctgctctccaagatgtggagttttttaaattatacaatttggttgcaccttaggggatccctctgattatggaggcacagtaaggtcctgagcataggtggtcagcagtccagaaagggagaaggccgagggcagactggagaatgggactggtgagattcagataggaagagcaggggagaaatggtcaaagtgagactggaatcaaaaggttggcatttctaaaaactataattgcacttaagaagttttgccaaaggcgatttagttaccccacagtgaggaacatgggtgcctatgtctccagtcacttccccacaagaaacctaattgcagcctgggctccgtgcaactcccagcttgaggggaggcccatgggcttctttgtgtgaggagcgcgctgcagcattcctgcccacacacgccactgctgcctttctcctgagaaggagttccgttattatttcatgtgacctcacagccaggggagctggtttgccattttgcataacacacattaaatttgtttttagatgtgctgttgagccttgcctgtggatcttctgtcctcttgtcggtccctgcctgctgcagccatccaggcacttaggatgcctatctttttctctacagctgcgaggagcccagtagttgggtttccttaaatgcaagcagatggaagcgagcaggagtgtggaggcaattagaggatttcctcctccaagcagtgcgggtttgctctctctttgggtgtgtggctgttcttgctcattttaattttccatttgggttttgtcaggctgtcagcttttttttctggctgtattatgctgctggttgcaggagcttgcaaaatggggtgatttggttgcttattgtttggaatcaaacttttcacagtacggtatgggtgacgcatatcgtgatgatgatgacacttcatatttgtaaaatattctgcaacgtaaagaatgttttcacatacgtcactgtctcatttggtctggacagaggcccagaaaaaaaaaaaaatgaaggctgtactcagtctgctagagtcaaagttttgccttatctttttacgccatctctagtcaaaccacagcggagagaataatcgaatgaaaactgaagctttctgctttattccttttctccttctcctttcagtcaggtaaatatttttcactttctgaacacagtgttagattctctggtgacaattaaataatcgtagcagataatcgttgccgtcggggagctttcaatgtaggtggggagacaagacatacaacagtgagtttacataacagtgcctggcacacagaaggcactaaggaactaggtgctgaatgagtgggtgagtaaatgaatgtggaacatagcccaccaaagtcctgaagggcaagaacccctagggggggaaccaaaagatccacagtccttgatgagaatgggcaccgagtgcctgggtgcctgggagtgagcaggcgagaggacccagcaccgttgtggacagcctccgttcggttagcaccactgcacgagggctggagtagagaggaagccatttgtttatgagctgagaagagtgagcaggaaaaatgccattctttgctcttaaggatgagacaagcataaaaagagaggcagacaggcagaccagaaggaagagattgctgacaaaatcattgtcaggaaaagtgccagtgaaatcactccaccttaaaagatctatgttctggttttgagaacctactatattgtagacctgtgccagaagccagaagaaggcaatgggaagaatcaaagagattcttggccccaacccttaccagaccctgccatgcacaggaaacagttaaacaatgtgactgtctcacctgcaaatgatcaagtgttgggtataagccaaggagctgagagagggggagaccagcgcaggtctgaggagctgagaagggaggcttacgtgaagggtaagactcgcatgggcctggccggtggacaagatgtgggaactgcatggacagttatgtggaggtgcattccatcctggctggagagtgtgtgaggggcagtgggagattggtggaaaagatataggccactggtgtggaaggctgggaagccacgcttcagatcggagaaagttgctaatcagagaagcggcgttctggaggtggtaagtggagctttgttcatgcccagaattttcattcctgtcctgccgtcctaaatgctgggctgcagtctgcactgtcccccgctgatggtatgagagtaagccaaaggaaggaaacatcttgttgggatggcactgagccatttcagtgtctcctgggggcactgagccatgccccagggcaaatgcccagtggagaacaggagttcaggagaaaaggtcgtcctccagtctaacaatcagcaggacacttggcttttgttgggtattttcactgccatgaaactatacttggtttgtgaatgttttggtgaccaccaaaaatgtatatgatgtgaattctaggcattttcattatggtggatttttttaaataacgtccacattaatatacacccctagtgtaaagtacttaaagatacagaacaaaacaaaagtcacctattaacccatcacacagagatagtcacgcacatcattagtattttgttgaatgtcctttcccggtgcaaatttaggaatgtttaaaacatggtttcaaattggacttaatgttttatatcctactttgttttaacttagcagtgcaccgtgaatattttttagtcactaaatttatgttgcaatatgattttagtgctatatactattccattataggtatgtactatatttaatcaaacagaaaatcagtctactatctttgcttattttgatgtttccagtgagttaggcttttaacatatttttaaaaacaacatcagaatctagtgttttcagataaccatgtttttattgagtgagttgtccagcaagatccacgtgaatatagaacattctctacccttttatctcattttttttgtcacttcattaaaaatggtaataagtcaacccctctgtggaaaaaagaaatcgtatgtgccatagtttccttctctaagactgttaaaaacatgagctgaccaggcccccatgccgatggacatacctggatatacagtaagagtacagggaacgcaattggatcaagaagttcttagaatttaaatgacatcctgtgttttgttgtagtgaaatttcaacagaagtaactctccctattatcttcatgtaaatgaagaaccaagcattcaagagctttcttaagagctttgcctacctcttgaccaatgtctcccttcatagcatccatctccttcctgatgtgggatgccattttggagggccacttcctgctgactttattgtaagctgtgtagaagagaaggtatcagccatatttttccttttaggcagagtttgatttgcagaggcctggacttcctgcttatgtgtctttccagtgaataagtgtgattcaccacagttcaaagtaaccccatctacaacgcctcatttttttaagtgaaatttttccatgggaatagaatagagaggaatcctgtaggtcttccatgaaattatactccctgcctctcagagttttacaatataattaggttacttgtttgtcttaaatttttttattatcctgtgcttatctggttgaggtgcctgttgaagagcaggagatgaaggtcaagaaatataagcacagtgctcaattttttaaaataactttgtcttactgttgctcgtggatagaaataaaatttttcatattaaactaatacttagccgtttgctgaaacctcttatcaattctaataatttatctgtattctcttagtttttctgtgtaacagacataccatctataaataattacaagtttttgttctttttcaatcttttatcttttatatatttattttttcttttcctaccactctggctaggacctgcaggaaatagcacaggggataggaagtagggatagcggggataggaagtagggatagcacagatccttagcttgttactgattttaaagggaaggctgttagcatttcaccattgagtatggtgcttactgctgggttttggtaaatactttctattagattatgaaagtccccttctgatcctagtttgctaaaagtttctattttaaaaaattataaatgtgttaattattactgagtgccttttctgtatctattgataagatcattggggttttctcttttaatcggatagtacaggaattattgtcatccattttttaaagttaaatcatccttgcattattagcaaaaatccacattagtcgtgatatattttatgcattgttgggttctgtttgctgatattttatttaggatttttacatttgtatttatatctgagagtggtccataattttcctttttcctaccatcttggatttggttctgagatagtcctagtgcttttccattttctatctcctgcatttttttttggttttgatctaaaacacagattttttttttacttttttttctctaaaaccatctgaacctagtgtttattggtttttggatttttttgggtggaaggatgagaagctttttaactaatgaatcagttttttaaaggttattagactattcaggtttctgtcttgttagaataataatttgaatttttctgtgatattcttcatttcattgaaattttcaaacttaatggcacatatttcttcatagtagtgtgctgttatttaatccttgctgaatctgtagttatgttctctcattcattcctaatgttattatttgtaacatctctgtatttttcttgatcagatttggctcttattagtctttccaaataaatagcttttcctttgttcatcttctctagtgtatctttgttttctgattttaatttctaccctttattattttcttcttctgctttctttggatgtactcttatttactttctgacttcctgagttggatacttgttcattaattctcagtccttttttctttctaggacaagatttaagtattttattctaaataaaactgtagtgaaatctgatatattctaatatggagtatttttatcatcactcagttataagaatgttgtaattaccataattatttcttctttgattcatgagttttattagcagcatcattttgaattcccaaatgaatgagagtctttagtaatcattttgttacggatttctaacttaaaaaatctgttgtggtctgggaatgttgtttgtatgatactatttccacaaaatgcattgagacttggtttgtggcctaggacatggtcaattctttttaaatattccgtgaatttctttagtgcatattctccgatgggggctgtggggacagagttctaaatatgcccattagattaaatctcttcattctgttgctcacatcttctatatccttattaatctgtcaatctcttcaagagaggtgttattaaaatctctcactgtatgtgtcactttgcccttaaaattctgatgatttgctttataaatggttataaccattttccaggaagaacattaaagaactttccattggcattatccagtttccctcaaaatactggttttttttattttggcttctaagcagctatgaatccagtttctcagaagcccttgtctcaaggcatttgtttccagattaccttgttagcatccacactatgggctattttagaaaaacaaaaaaagtatcaaaatcatatagctatgattttcctgtgcttgaaggagccttaaagctcatctagtccagccagtatttgttcatccaaattctgccaagaaatctctattgtcaagatattctttaccatctttgggacattctcattattagaaacaaatcctaagaagaaattctgccatatacaacccatccgttctttaaaaaaaaaaaaaaaacagcttaaattttcttgtctaagcacaacaatttccagtgtttgtattagtttttctcaacagaatttcgagtccttttaacatcgtattactgttaacaagttctaaattctgtgtggtcatgctttgagagactgtcagattatacacacacactcaggttgtgtgtgtgtttgtgtgtttgtgttaaggaatgttttagtgggcacctattaaggaagcctctcaggaaactactgtatattaaggccaaaaccaactgaacccatcatacgatttctctccctcaaggaaagcaaatgagaatgagcgactgtaacccttgcctgttgttcataagcatgtacaccaggatctgtgtgatccttttcctgaagataaacagcatactgctcaaggaaggaaaacaacgcatagcaacaaatttcctgttttttaaagaaagatccaacttggtttagaaattatgctggcttgctttctatgtttctaatagagaataaggagaaacttgcttctcatttgccgacatgaggtaagtgttatgtctgaaagttccagagatcacagtttatacattgaagaaaggtagtaaaaggtttgcgaagacctccttccccgtgggagaggtgccctactgtgcatgccgggagttggctgtgggtcatgggcacagtacccctcacccaaatgattcttcccaaccatcaagaaagtaaaccccaacttggggcccagaaatattcagacagtagaagagttccacattcagacagacgataaaagaaatatcttcatattgcctagcattgaatttgataaggaatagaggaacagtattgtccttctgaccgggctctgtctcttgctgcctaaaattttattatcattgcatttaaaaaaatcaaagttcagtcttactagaatggatagaatgggtaagtgtagcttctagtttggtgagtccttcactgtttcttcctactaacctccctagctcagtctggctaagggcagggcctccatgatgaccagcaaaacttctctctggttaagctgagcttggtttgttaagcaactatacccaacatgtttatatcaaaagcacctgtgtttctcagtgtttctggaatcccaacttaagtgaggccggagctaatgctgtatttcagtaaataccacattagatcacacttttaagcagccatgtcaaacaattgacttaaattgaaattactttcagctaacacttccccacaaattgtttttacacatgctgctgctaaaccacatgtccaccgtcctgtacttaggcaacttttttttttttttggtttaggccctcacatttgtccttactaattttatcatgtcagttgtggcctaatactccagcctaccaagatatttttatatcttgagattgtcactcctgtcccttcaaaagtttgttccatctgaatatttcaccatacaaattttcaatatcttcatctaagatgttgacaagtttttgaagagctcagagccccattttaggcctcctgagaccaccttctaggtggacctgagctcaccaatcagccccacttaaatattataattcacttcattgttctagtatctagcccacattttcctatcttattcccaaaggtattatgagaggcctttttggataatgcattactgaaatctgtaaagaaccacacttctctgacccctgtcaaaatagaaagtggcatgactattcctcctatgaaagcatcctgtatggaggatcagaccaaatgctaaaacactttagtaggtttacctaaatacagcttgtctttcatatatcatgccttgacacttcttctgcaagaccagttttttctgtaagactaattgatattgagatttcaatatatatagaaatgggactaaattttatccaaagctatttttgcctctattttgggggcattcaagttaatttcccccacttacactaaactgtcaaatactagaatgtggaagcttgaatattagagataagtaagtgcccagttccattccaccagttcacagccctgtctatccctccatcccaccctcaccaccaccctcctaaagcaagattattaacactgaactggactgctaaaacttcttcctagcatctttcaggtgcttttgtggcagagccattctgcatggagctgccagaccaagtgtcattcttgcttagaactcttcagagcctcccctctgagctccaaattcagtccaagtcctctcttggctgcttgcctgatcagaggagccactgcctccccactcagaccctattccacctggtggacttgtcactcttccctaaatgtcttccatgcctccctgatgcccatctttgccctggcttttcctgtggccaggaatgtctcaaccctgctctagatttagaaatcttgcttctttctcaaacaacaaaatgtctctcctcaatggagccttgactgatctctccattggaagtgacttctttttccactaagctcctgttagcaccctacaacttccaactgacaattgtcttgcatagaattatttgtacacttgttttatcaaaagctgctccagtgggctgatagcttattcatctttttaattcaccaagggctgagcatttagtagagaggatgtatttgttggatggatcatgggtagatggatagatggaggaatggatggagttgaggtttaagagaggataaataacttgccaagatcacgaagttggactaatagaattaataatagactcagttcccaaattcagtattaacatatttgtctagcaccactccacattctcttccatggttttgctttgaacttttggtagaagccttagtaataaacatccagttttataaaataaagtcttatatttgtttatattataaatttattactccttgatttacatgcttaggaatataaatctgagaaaaatacatggtaggattttcctaccacattctaaaagcttaagaaatatctgaagctaagcatggtggctcatgcctgtaatcccagcactttgagaggccgaggcaagagggttgcttgagctcaggagttcaacaccagcctgggcaacatagtgagaccttgtttctaccaaaaaaaaagattatttacatgtggtggtgcacaactgtagtcccaggtactgggaggcgtaggtagaaggatagcttgagcccaggaggttgaggctgcagggagctgtgattgtgccactgcactccagcctagatgaccgagcaagatgctgtctcaaaaaaaaaaagaaagaatttgaatggagacactgccacttctgcacatctgtcctatatgatttaaaatatctctgaataccttgaaaacactgatcttttcaactctaaaactcagaattctcttaataaaatagtatgctgtagttatactgtgtcagcagttttggggggtttttgttgttaattgtttgttgtttttgtgagacatgggctagggatctgatgttaaaaatagacattaagccccaggacaaaatggccattctacctagagacagcagttctggcgttctgaggccacagtgtaacataaacatgatgttgtcaacctgagccagggctgatttgcctcatttgaatctgaaagggagcccacatccttcctgttgctacacaaagatgctgaaaagaattcacagagaaaacaaatggactaatgcgtgttatgtttcccagaagttctgtccccagtgcccccaaaatagtaaaatagttgggaatgaggttgagcaagaaaagaataaaggaataaaagtatacaatgccaaggaaaggccaatagaaactattctttttgctttgcttctcttggtgtttttttccagtgtgactctgtagataatggcaaagagaaatgcagggtcattttttccattttcaagtaaaacttattttgcacaatagacccactgaggcttgcactcattcatgtctacgactcccatctctccagtctcaacaaaagtgaaggtggccattgtgtcctttcattgttctgtgactttgctgcccctttcttgctttttaaaataagttccttagaagtatggaatggcgggaacgcatgccctttgtttcagcaattcagtcaaaatttcccaacttgccttcaatgttagtaaaaaaaaaaaaaaaaaaatgacatgaattgtactggcatgaatctaggtggtctggccaacaaagaaaggaaaggagggaagaaaatgaggaaaggaggagagaggaagagcctgcatccctaaaatttcttttctcaacaaatatttacttggttacctctattacaggcatttatggtcattgtattaattcattctcacattactgtaaagaaatacctgagactgagtaatttataaagaaaagaggtataattggctcgtggttctgcaggttgtacaggaagcatagcggcttctgcttccagggaggcctccggaagcttccaatcatggcggaaggcaaaggggaagcgaggcatctcacatggtgggagcaggagagagggctaggagaaaggtgctacccacttttaaacaaccagatctcacaagaactcactgtcatgaggacagtaccaaggaggatggtgctaaaccattcatgagaaactacccccatgacccaattacctcccaccaggcctcacctccaaagttggggattataattcgacatgagatttggacggagacatacatgcaaactgtatcggttatgttgcagaaagtcagaatggaaggaatctggagccaagtacataaaggcaggagctacttcaaaacggacatatatgttagtagcagttgtacatgctgtcactcttggatcagaagttaaagatgtcagacttaaactggatgtaacagggaaattctacagatgtggggatgcaaattatgggattttttttttttccaggagaaatcatgcagtcttcctagaggtctccatcataagcgagttttccatcatgtaggtcatttatccctgtcatttcttaattccatatttgtttccacacacagattttgaacatatattttgaacatatatttatttaaaatatttgtttttatctagcattgtgctgaaagttttaccctattataattgtgttatctacatttaagttttttaccttttaaggaaaagaaaaaggagaaactctacaatcatgcaaaaagtatataatttgcctgggagatgcagaataacttctagcagataattacatgctttgaacatgaaaagaaatagggtagaacctgaactaaaagaggaccaggttctgttctccctccctcaggggaggatattttagaatattttgtgttcatgttttaataagcttttgttggattattaaggtgcatttaagtttttccatcttagaagtattcggctggtgcaaaagtaattaccaattactaatataatcttgtcaagtaaaacccactcattggggtacatagagcaagcatcctcttttccgtagggcagctcagtctgtgtatcataaacatgattatcattgccattcaattttagctgttgctccagagagacttaaaggcatgtcacatgtgagagatcagcaggcaatatttggggctatgaatattgagcaaatattaaggtttttttaaagttcaccttcactcatgatttacctgccctaaggaatttgccacagattccaaatgtcagcactagaagaagtgtccgagatgatctggatgaaccattatagtgactgaggcccaggaagagtgagtggtttaccttaggtaaccagcaggtcagggtagaatgcatgtttctgttcagtcattttattcacctcctaggaaacatattgcagtgcagttggtttgccacttttgatcaaatgcaccaaatcttcaatttggattaatcttttcaattactgagtataccggtcctttcccatagacttagaacaaactacaaatgcaggcaacacaggtaattaattttaaattaccgagtagccacatttaaaaagcaaaaagaaacacatgaaagtaatgttaatatttttaaatttaagacgacctgtgtaaaatattatcatttcaacatgtaatcatattttaaaatttattaaacattttacattcttttttcatgctgtctttgaaacctggttatatgctttatacttacattacatctcatcttgaaccagccacatgtggttagtgcttgcttaccctattagcacaggtctatatggatgaacaggtccaagctctacaccaaaccacaggcccctaacccttgagatcaaaaatgtctctgagtactagttcccatttctttgaatttttgctcttgatacgccatgcatgtctcctgaaaacccagagaggtgagcaagcatgaactgctataaaatgagtgtgtctgttgaaaacatggtccagctcctgctaagatagcgtcattctgtgatacaatattcctgtcttcatctaattccatgaagttctgcatttccttaatgtcaaaagttcccttaccagctgcagccgtttcctgtggataatgttctaaatggcttttatttatgagatgtcttgtgctataactgctatcagaatgaatgtgtattccaaaacctattccccaagtcagtctaattaacaatcttctaagaaataattgttaaacttcagctgtagctcacaacacgggtatgtctcgctttgacctaattacagaatgtaatgttaaaatatgtaaggaaggagatcaaagaggaaagtcattttgctttctatgtcttcatcttgctttctatgtgcctcatatttcacagctcccaacctccacttccaactggctgagggaaggaaacacatggaatagtaatgaatgagtatagacgctgaggctgttttattttcctcatctttgaagcaggaacaataatagtgcctatcctggagattcgtaagaatgaagcatgaagcatgggatctgacatatcgttgatgctcaacaaatattaaattgcttcagaaaaatagcaaataggtatatctggtgcgaaaaatggaaaggaagcctgccagctttttttaaggacactatctgcattattcttggaattgaatccggctccacccagggctgagagcttttcgtttccattgtgtctttagcatagccatgcaaaccaacatcacttccaatgataggggaatgctggagtcaaagcgactagttcacttcagaggacaggcagtgtataatgtcagggggaggagctgacccaaataatgtgtttcaagtcatcagaacacgttcatgtctggttttcatagtaaattgtgacagctgcgcaggagaagacagaatacactttttagatgttattttgtttattttgtgatgctgctttaaacagttccacagagtaaggaaatggagtttttacactgtgagactttaactcccttctttccttgacttgcctcttggctctgcttaataagccctttcagcaagacctcatctgctttccttgaagcttccaggtattatctcttggttgaatataacaaaaatcacaccaagtagctacctgacactcatgggtgcaagtatctcataggaaactggtgaattctgaaaatgcttttgagccacttcctttcactgctggactctcttaatctacttactaaagtgctacttggacaagagagtattgacagttacagggaaaaacaatgtagaatcccaggccatgtgtaggtttctgtggacacattttaattttttaaagaatattttagttatctaaattatgtacctaaccatttatattgagtacataaattctcagtaaattagcgtctctcttttgagggctgtgtgttatctgctcctgtgatccaaatatatagcactaagacaatataagggattctctctctctctctgtctctcattctctctctctcttccttccccccttcctttctctccctgcctccctccctctaccctctctctgtttgtcctaatttacctgacgttttagcccttgttgctgttggaggattctaaagatgaagccactcataaccttaatgcctgatagcatagagaatagttggtgacttcaccagaacttacacacccatgccttttcttttttgctttgccatgagtaggcagttgcatactttatttagcaaaagagagaactgttaaaaagctactaagtagtggtatattcataccatggaatactactaggcaataaaagctactataatggataaagcaataaaaactactatgccactcagcagcaataaactactgaatatacaatatcatggacaaatgtcaaaaacttgccacataaaataagtagacacaaagaatacatactgtatgattacctttatatgaaaccctagaccagagaaaactaatctgtcgtggtagaaatcacaaccgtgtttgcctgggatggaattgactacaaagggaccccagtgcatctttctagggtgatgaaaatgttctagatcttgatgggggtttagattatacaggtatatacgtttgtcagaactcattgaactgtaaacttaaatctgtttatacattgcactgtggataaattatgcctaaactttaaaaaaaagaagagggaactaaaaaatccacacgccttgctaaacctcctcaaattattagaaattctctttcacttatgaactattttcttgaaagacagctaccaggtatcactatcaccatctttttgtaccaggtacgtgggttcctttcagactcttcctggtgctgcaatacacagtggtcacccacatttgagaaacatacagtgccttccttttcccaggagattatcccagagttacatgggaaatcaatgttgtataagttgcacaggggaaacattactgaaggcatttttttggaaggtataagtgtattcactccccagtgtattgtgggctgtgttaattcagaatttggaagagaatgctcttaagccaggatgttttgtaaagtgttctgtgttgcaatgtgcagatgtttacatcaaattttaaatctttcacttacctgctcaccttctccctccagaacatgctgcctgttgttaagcactgtttctgaaatacaaatccattgtgcaactcttgctcagaaactacagtggcctgctccctccttcacatttgggccctgcttaactctctagttacctgcattcgctcattcttggcttgtgtcacaccaaacaaagctgctccctggcatgctcctctctcctgaatccatgcctttgtaagagctgttctgcagcctgcaaagcaccctgcccatccccttgcgcaccccctttttcaccagtccttcccacaggccccactcagatgcccatcctctgagaacccatcccagcttttgcaggagggatgagtcacatgcccaagcttcaagaacactgtatgtgtttcttcaggcaagcaggcttactacattggagagaacaggtcctttccttgtctgccttctcccatgggctggacacccttcagtgaaagagatggcattcgcgtctgtattttgtgcacactgcttggatacatagtatttgcccatgaatgatgggtgaatgggtgggtaggtggatggatggatagattcattcactcactcactcattcattcaacactgcagcagtagccttctttgtgggaccaccaaagaggagacaaataagaaccagaatgttgtgtggccctagcaaaagcagatttttctgggcggatgttaaagtattccagtcccactttccttgctttatttttccaagcaataaggagaacatgacaatattctttgccggggttgtactttctacctctcctctgcataagggtattcctacctaattctaagagaaaaaatgaaaacttaccactaatgatataaaaagcatatttattgttaggtgatatttgtattttgggggttttttcctcactaggaaaattttctaaatacctttgcatataccactttgttttatctttacaaaaatctcattaattaagcaggggatggatcatcattcccaccaggcaaatgagataactgacgtgtagtaaaagcctgatgatttttccaaagttacacatctggttagtgataatgctgggaccagaataggagtccatgtgttcccaccagactgggagattgttccaaagaacaagttcccaggaaagatcaaataattgctggaaaagcacttccgatctccagcaaaaacagatctttccagctgagtgccctccctaaggcctgaagagtattatctgccaagtagctattcttttgtcttctgcataaaccactgcaggctgaaggccactgtgaaatctgtgagaatcaagagcagccatccactgcagaaatatatgttatgaaacttaaggaataagtcactgtccatccagagagaaattagagaatgccttttctgaaatctctgctaggacacaggtgtgggccctaacgcagatatgaagctttgtccccagtgctaagacgagacagctatttttgctgggccaatgtaatatttaaaagcaaacatttaacagtaggataacggctgctgaagctgcatttgcagctgcagctgcatcattcctctggggaaggcaagatggctcttctccagctattcatgaagggcaagagttgggagcagaaagagaatttgctcatacgtaatactgtgcggtccaatctcatgtcccatgtgagatgcctaagtcagaagctgactgcaaagacagctcatcggcttggagacccagggttcattctgcaagatctttcaggccactttttttctataataaatgaaatcctttgcattttattgggagtaagagagccagatcttttcagacattaacaaatgaggggccgtgaatgtggtccaccttactgatttgctgcaccaaggagaccacagtcactccagatcttaaacatattcataattgtgtttggagcaaagttaccattggaatcagattttcacagtgctggtaccgatctctgggatcctcttgtccttttttgcatttactctgctctgttccttctttcccacttatcttcctttcagggtctccactggctgtctttgctaaccaaatatacaggagtttccttggtcacaattagaaaatgagcttccaaaagaagaggcaccgagggcccttggcacaggacacaggaagggactgatcacgtgagctgtctcagttgaatccctcatttctctgatgcggtcgccagaattactcaaagtatttcattttattttcatgtaaaacccatttatacagctgcctcagggatctgttataaaacatgtggagaaaaatcatgatgtaaagtaagaaatacagggatacagatagaggaagccacatttttgttaaccttgttctttggaattctgatcaaaactacgatgtaaaagattcttggccaggcgcggtggctcacgcctataatcccagcactttgggagaccaaggtgggcagatcacgaggtcaggagttcaagaccagcctggccaacataaccaaaccccatctctactaaaaatacaaaaattagccaggcatggtggcgcgcacctgcagttccagctactcgggaggctgaggcaggagaattgcttgaaaccgggaggcagaggttgcaacgagccgagatcgtgccactgcactccagcctgggcaacagaacgagactccctctcaaaaaaaaaaaaaaaaagattcttatcaagcccctttgtgatctcaatatttatagcactttctcaaacttgtggtcgtgtgtgaccaaaacgtaggacaaattgtaactcattggttgcacgggtatttgtaggcatggggaccttgtcacccggacttctctgtcccttgtttatgtcctcttcagtaaatgggaatggagcaataactagtttctagtttacttttgacataagatggtaaatgatatattcccatctttgtgtttggcttttagcctttgaatttaaacttagttcttcaaagagtggaacagttctgttcagttgcaaagcctattagggcctttttgcacagaacatgtgcaaattcttccctttgttggaagctgagatccatgataaattccccctctcccacttacttcacagaaggcttgcaataataagccaggcatcaacttggatcatctttactctggggttttggggttagaagttgctgaatatcatgttaatgaataaacctggccctcagacccagagaaatgattggatgttaatatcagtgtatatgcttttagtgccattaacaacgtgatgtattacaatttcttaagggtgtttttttctacactggaagatgttgatttgccactctgaatgccaccagcttttcattctgaaagttggagaatgagcataaactttatagtcagatagacttggatttgaaatctgattctgtcactgcctggtggtttgctcttagggaagttccttaacctctctgaggttagattttctatagtaaaaaggattaaacaaacaagtaaaatgtagaccatcccgcacaatgcctggaggagaggaggctctcaaaaattacttatccctgtttgcttcccttctttttcagttggaacttctggaagggggtgtgaaagctagggttttccttagcatgggggattattttaatcactatcattcctacagaaagagcaagacatttctaagggagccgtaagaggcaatatggcatagcctagtggatctcagagtgtagcccaggaccagcacagccagcataaccctgggacttgtcagaacgcaggacttaggcttgatgttgcttcagaccaaccgcatcagaaattctcagggggaggcccagtggtctgtgttttcacaagtccttcaggaaattctcatgctcataaagttcgaaaaccactagtgtagtgaaaaatacactggactagtttcttgcacattctgctgaaacgagaggtgggattggaccaaatgtcctctaagatcttttctaattctggcatcttgtggttctagttttaagccagctgttgtcaccattttcttagaatgaccatgttctttaaaagggaaaagaaaaaaaactggtttattattttttatttcaaaagtaacacactgttataaaaaatgaatataaacaaaatgaaaaaacttaaaaccatccaaaactcaacatcctgagatattcttttatgctgtgctcttattgtccttcttttatgcagatgcacacgtatgcattactctgtgtgtacatacataaacatctcaccatagccattagcatccactgagtgtctgctctgtgccaggcacagttttgggcattatgggtataccatccagcaaagcctctactcccattgagctttctttctcatgagtggaggtagataataaacaagaaaacacctaaataaagaccatttctgagattgttaaatgccatgaagcaaataaaacagtgatgtgaaagagtgaccaggcaatgggcaattaagatctgataccaggaaaaacctttctttctttttttttttttttgagacagggtctcactctgtcacccaggctgacacgatcatggctcactacaatctctgccttcctgcctcaagggttcttccttgagcacctcagcctcccaagtagctgggaccacaggtgagcaccaccacacccagctaatttttgtattttgtaaagtagggtttcgtcatgtagctcaggctggtctcaaacttctgggctcaaatgatctacctgcctccacctcccaaagaggaaaaacctttctgagaggtggcatctgggctgagacctgagaaggagccagctgtgtgagtattttggggaagagcatttcaggcaaaggggaaagtttgtgcagactcactgaagtaaaacagagcagagtgtgttcaaagaagaacagaaaggtgtgcagtgttgctggggaggaggtgtgaagagggaaccacagaagatggggctagacacataggccagggccagagcaggatgaccatatcatttaaattcattccaaagacaataggaaaccattttaagcctgggagtaactttaaaaaaagatgactctgactgtcatagagggtatagagcgcaagattggaagcaaggaaagtagttatgtttctacctcgtgttttgtgacttgtatatttcccttcactatttcattaatatctttcaggattgttaatgtcctgctgtgttctcatttttaacagctgcataggaatctggtatgataccctactttgttaatcctctgagtgcctagattgtatccaatttttttattatcatgaacagcactgaaatgagtgttgttaaatctttctgcacatttttgttctcaggataattcccaacaggggaagtccttgaccaagagtaggattcatttgaagactttttctcgagtctattagttggtttcatctgtatttatttaactgagcattttcaattatttaaaacctttagttgataagcttttactagataggggccaaagtgagatactcccagcactttgggagaccgagtgggtggatcacaaggtcaggagttcaagaccagcctggccaacatggtgaaaccccatctctactaaaaataccaaaattagctgggcgtggtggcaggcatctgtaatcccagctactggggaggctgaggcaggagaattatttgaacccaggagacagaggttgccgtgagctaagattgcacctttgggttccagcctgggcgacagggtgagactccatcttaacaacaacaacaacaaaagattgtcaagtatcagtaactttctatcagtaatttatagtagttggcataatccacattttacagggaagaaaccagaatctttttaaccacctactcaaaatagaaacccttcatcttaatcatggctttgtacacttctgacaccctgagggaatgagaaaggaagagagcaggaggaggagagaagtggaaggaaacctgcctcaaaactgatggagtggaactgaaaccattataagaaaaatcacttctgtttctctcccacatgccactcaaataatgaactgcccagcggcggggcctctcatgagacaggcggctgggcaggcagcaggcagctccagtgggaccacagcatccccaggcaggagccagaaccctgccagggctgtgggcatgtggccaagttgtggggagatgggctccctgtatgtcctccttgagccccattccagactccatttgtgtttatctcatatcatcatctccatttcctctcaacagagcctccacatctcccgtgcatgtgcatcttgccagagccctgcactgtcctcagtgaacaatttaaacagattgtctccaccctccgtgcactgctggtgccgaagggcaggacaggtttcaggtgcccagtggaatctgtagagcttttgacaccttgtaggtatctttaaacctaaaagaacgatagcaacatggtcattggtactttgccctggggtcacttcagttcaaaataggagagtgatggcaatggacagagttaggcattcggcttcatgtagggatggggagagaagccattcttggcaggaggaatgcatggaagtgcaggtgacagagcaccattatacaactttcattagggagaacagagcaggaggagggagggcagcttcacaccagaaggcagaaagcccctccccgccccaccaagaagaagttctttattctactttctcatcctcatctgaaagtattgcttaataaaggccagccttcacagggctcacccctcagtgttaccttctaaagccccacctagatgtttcctctttcagccagggaggatcacattcatagcagcaccagggctgggtgggcactttaggtctttgtgttgaaaatgaggatgatgccaatgccgacccaagcccatcactaggtgaggtgagttttgagccacatcttgctcagacagctaggggtgaccaagagggaagagcaggcagctggtgagcaaaagcatgctgatactgtgctggattttcccagatcctcagaatagttacctttgaccagggaggagcatctccgatggatgtgcaattccccattacccctctccagtgagcagctttgcctggctgcagccatgagccttgggggcacctgactccaaaaacagatgtgagttgaggttgtaagccttcagtccaagacccctgcaggggaggaggtaacatcaccagtggacctataaaaagtgcagatacctcagattcctgagcctcaccttaaaccctcagggtgcatgtatttcctgtttcaggtaggcatggttctttggggtttatgcctaggagtggagttctgctcatgggataggtacatcttcatcttcactagtaatgtaaaattgttgacgtcctgctagcggtgtgtgtggagctcttgttccacattttcaccagtacttgctcctaacagactgaaaattctgccagtagcatcactttatgttggaattgcaatatagaaatggaggatgacagttcatgatgggtgttgtgttgtttaggttgaaaatgagtgagagttttgtcacctggcctagcaggaaagtaaaaatgctctggtaccaaagaaaaaattatttgtttatttgtttttttatgggaaaatagtcaaaattaaggaaaatttgaggccattagtgatattgtgaagtgtatatttggtcactgttttctggcaaacagctcctaaaatccttggaatctccaaagtagtaaacgtctagaggatggggactggtcatgggaaagagaggattagagggttgggactttgagccttatctcccagtctttggggagagaaaaggggactgaaggttaagttgatcaccagtggccagtgatttaatcaatcatgcttatgtaatgaggcctccataaaaagtcaagaggacagagtttggagagcttctagatagctgaacatgtgcaggttcctggagggtggcagggcacagaagccgtggacgctccacgccctttccttcatacctcaccctgtgtatctcttcatctgtatcctttaaaacatcctttataatgaagtagtaaacataactgtttccctgggttctgtgagctgctgtagcaaatgagtcaaacccaaggagggggttgtggagatcccgatttatagccggtgggttagaagcacataccacaacctggggcctgtgactcatgtcttaagtggggagcagttttgtgaaactaagccctcaacctgtaggatctgacactatctctaggtagatattggcaccaaattgaattgaactggagaacagccagctgtgtccactgcaaaattgcttgcttgcttgcttgatatgtggggaaacaaaacccacacatctggtgtcagaagcatgttgtaagagtagaggagaaactaagtttgtttattcctctgtccacaccattattttaaagagtcgagtgtttgaggcacaaaacaaatagtgacaagaatggatgattaaccagcaaccatgttagaacagaaacagatttcaaacagttgagatagttaagaaaaacaaagttagggaacagtttagtgggtttggaaaagtagaaatggtataaataatcagtctcttctataagagttatgcagatccactaattgttagcagtatttttattttagcagtgaacctatatagaaaatacaagtcttaagagagaagcaagatggctagaaaatgatgaagggacttagaggggagtgcatttagtgcgtccagattaaggaataaacctggtggaacggtgaatactcagaatgtgtaggctggttgtacacaggaccattttgtttcacttgggctggaaatcagcatgtcgagtcagcttttgtcacaaagaattatggcagagctgtttcctgggcttatttcatgtgtgtaccatcattacttgctgggtcagtttgggttgtattgagccagaactggggcagggcatgaagccacccttgggccatcattacctggaatcttctaaggcagctccatcggagctctcagggacaggccagttctgcttagtgctgggacaaagtgcttctgccagagctgccgattgatgactcttgctggtggatgagcaagagtttacatcctctgactgttctaagcctgtatatgtgagtagagctgtcattgctgaaaaaataagctgccttctagcccaaagaatgtgttaatattatattttttatgcaaaactgaagtgtaactgccacttctgcatcatgataaagacattcgtatttgacttgacagagcaaacccctccacagctggaggagaacagtggtgatcccctgtgacctcacattcatctgcacctctaaccctagccactccttcaggatcctcttgtgacaccggtctgttgttggattctacttgttacatgcccttttcagtgggcattcctgtctttcttctgatgacctgcattgcagatgtctatctgtggtgttacctgtcctcatcatgtttaggcagccacttacacaactgtgcaagcctatttctcactcctaccagccccaaaagatatgaagtgttttgtgtgccagggctctcagataatgtcacttatatagttccaaagtagatcacctctgcagccatttatggtttcagatctttattctcacatgtaacaaaagctacggctttgccacagttggggatgatttgtgaggtatgaattatgaatagacaggtagctagaatggatagagtcattggtccacttaggaagtcatagcttacttagatacctccctgtccagccacttgcatgcagtctctttctacccttgccttcttgatctggcacccccccatgcttctcttttctccccagcttcagtatgtgtctatcaagacccagtttcactcctgcttaatactggataagtatcagttgtataatgtgcaaatgcttttgcttataggtctcagatttagccagatctgggttaaaatgcagttaaacctagcactgaggccttaggcaaataactttacctcccttcattgatgatgatgataatacccagcacaggatgttgatggatcaaaggtcatttgcatattgcacctaggaaagctttaggcaccatagtgagggctcagtagaatggactcatagttgtttaagatttggcttctgactgcttctcaagctcagccacttacccagctacacatttcaatcccattaaactataagctccttttgagcagggagcctgtcttcttcagccttagcacccaaagcctcgaaatatgcttggcacatatttgaatgctccataaatatggccataaatcaaataagccgtaagaacacttacggttctttgagggtatcatggtgttccacacctctgtgccctcagatatgctattcccttgcctgcagtgcccatctcctccctgcctgggctaatatccagtcactttctcaattgctgacctggatgaattagaactccctctgtgtcccctctccaacctgagtccctcgatttacttgtctgtctccctcttaagtatatattagctccctgaggacagaggccatgtgtacttgactttataccggcagcccttagcacagtgcctgtcacataaaggggatcaaaatatgcttgttgaataaaggctagagctggggctgaatataaataaaagggtatgtgcagagaaacaaaaatgcaaaggaaatgaaacagttgaaaactggtgatttgttactatggtgatttcggagtaacttttgtttggggtagggggggtcgtttcttcattcttgttattgttttcttctaacttcatctccagcagctcagaaggagaacagctgtacctagcaaccctgtagggtagagccagagagaagtggagcctccctgtgatgagggaggagggtcaagaccacagcatgtcatgaatgccagagttggttgagccagatcataagttgttcttcattttagcaacaaaggaaagtggaggacataggtcttctgaaaactgtagtaagaaagagtactttaaaccatagggcaaaaaattaaataaaaactgtaggacacagcaatgcctagctcttctcacatcattaaaactctcataatgtaccttctcaaggctctggcacagcaggggtcatctgagcatttagagccaaacctgagcacttggtcaggtcattccatgagtcctcataattcctgaggttcagctgagggccaagagctgcctgtctgtctgtggactcagtggttctgctcaatgtgtgcaaaaggtctttgggctccttcagcattggtgtgaaccctggagggctccttgttgaagctcacatttttttgtttgtttgtttgtttgttttttgtttgtttgagacagggtctcactctgtcacccaggctggagtgtagtagcacgaacatggctcattgcaacttcaatatcccgggctcaagtgatcctcccgccccagccccccaagtaactgagactacaggcacataccaccatgcctggctaatgtttgtatatttgtagagatggggtttctccatgttgcccaggctggtctccaattcctggcttcaagtattccgcccacctcagcctcccaaagtgctgggattacaggcatgagccaccgtgcctggcttggaagcccactttgctccactgatgagggaactggacttcagaacttcagagtgacacgctttgtgccacggggctactcagcagcctggttccaggctaatgcactgatgaggaaactgggctccagaacttcagagtgacacgctctgtaccacagggctactcagcaacctggttctgggctaatgcactgatgaggaaactgggctccagaacttcagagtgatacgctctgtgccacagggctactcagcatcctggttctgggctaatgcactgcttacagaccttctctaaaacagaagacttaattccagactaagatgtcccggagacttgggaacaaatgctaagctggacttagaaaatggctaggagcagagcacgcttctcaaaaaacagcatggtgtagtaggtagaagatgcaagcgtattagatctagattcatgtccaggtcccacggcctgagtaactctgggaaagttactccaattctgtgggcccaaggttccttgactgtaaaatatacttgtaaggttgctctgaggattaaatgagatagcatatgtaaaaggtcaagcagaaaataagttctcaaaaagtggtaggcattgttattgttactgttgttgttatcctactaacttgccttaattcaagtttaactgtttgtgtcaaaggtaatcagaagttcttattggttctcgggagtggggagacacgtggcccacacagccaccctttgacctctgtattagattcacttcctccgtgtgttgctgcagactccctgttataacaaagatcccactgcatgccctcccccatctcctcccaaagaagcagtggcccacacaagatcaatattcatgcctctcgtgttggggtcagtggtgggtgctttcgggtagacgagcagctgtgctccgtgaagctgtccggggcccaggttccttccatcctgtggtcctgctgttccctgttgggttgccattgtctgtctgttgaagccagttcaccagcaccacacccacttcccagcccacaggaagcaggaaggaaagtggaggacgaccagctcccttttgaaggattcaggagttgaatatattatacccagtcacaaggagttgactagaattaagtgatctggccacacctagctgcaagagagtctgagaatgcagtcttcagctgcaaagccagaggctcactaaagctattatgatggaggagggtggggtggatttggtgggacagcgaggggatagcaggcagcctgcacacccttcacctgccttcacccgccttcaccctccaccgctcgcttactttcagtgacgtggatttgggctgcaagattgccaaggccgtgtccctttagacccagggcaaccctgcctgataccagaatcctgcaagcacctaggaaaaagggaagattaactgctgtgccatttttaaggagtgaacttaaggtttaatcactctgtaggacaacagtataaaaaaacattgtattctctacctcattcataggccaagtgaaaagtcactattaaattgcttcaccataacttttacaagcagtagtgttcgcagaatgtatgctggtatgtaaacccagtgttaccttttttggatttgttaagaaaaatctgactgggtttccatcaggtgttaagtaggtcatccacaagtggtctagcccatgtagcacatgttcctcccacacagagtggccacagcttgtcatcccaaatactgttttttgtgtgctgctggggaaagcatcactaccttctggtggttccacattctcttcctcttactgatgttcctcctttaatttcctctgtgtctctcttggcactcaatttgcattcataaatgcagacctctagtgaaaactttactgagacacgcacgacatattcaaccaccctgggctcacccagggtgaggaaaccaacatcagggaaggcagagaccatcctcctttccttcaggcaataaagtgtaggaggaggctggctggagtctgcctctctgctccttttgttcccgtcctcctgagccattctgtccccatagaggccgtggaattagatagactatgctttctgactggctactttatctgcattcacaccaaaacagctgcaagaagctttgaaattctacaccacggcaggggatgcaaaagttatccctgctgttgttgctgatttctggcagcctgaataaagtgccaacacaaagacccaggggccgggggactgggcttcatgttattcttcaaaggaaagacaccagcctctgccccaaaaacacagtgcaagtggcctcacagccaaattctcaggctggtagatttagattgggctgtgacttcataaccagataaatgatcagcgaaaatgggagacatggagaccacaagcaccgtgctatcagctcaaaggcaaaagaagtcaaatctccttcttcaaagtcctttctgtgtctttaaaggaattggatcttcttgactggaactagtgaattaaagaaagagaaaaagaatgcactgtttttgaaaggatgaggccacatttgcagaatcatctggcgaggaacctctatagagactgggaagattggcagggcgggttttgttcggccttggagagtgaacctcctcggctttcattctcagcggtcctcgtacttggggagggggcattgatgacgcctattcaaacagccgctttgtgctaatgtgttttcttgtggctctgccaggtgacaccctgacccttgggccctcggccagttctgccaccactgttccttaaacaggcgcagcccagaaagctaggctctgccactgtggcccagatgtgacactgaccttcctgtttctctttgctggtcatgaatagaagcccacgtttttgtttttcttttctctttttctctggttgattgtttttatagaatgagggtaaggagggtaggaagatacttgattggatatcaacatcaggaagaaacatctcttctgtgcctagtgtttctgaaaattttcaggtcacatgaaccagtgttgcctactgttctgtgccctgcttggattgccccaggttctaggggcagtggctcaaagtcaaagcattaaaatgcccagctcagtgtcccaacaggaaagggtgaaggcaacaagagcgagggcaggcccccttccctctcccaccaattggcatccaaagaacaaaagtgctttgtttcatcctctccaccttcctagagccaagcccatgcgtggtcttcatgacctcactcacagagagctcctacagacacctcaggaatcagattgccttggttaggtgccaaggtagacttgagtgagtaccgtcattctgaatttagtgggtgtccccaagtacctaggatgtgtggcccaaagggtctcaaaaccccactaatccagccaccctgcttttggttcggttatcccagattccacacttgtcccctacaggatcctctgcatgtggctttgcctttttcgtgcccttaattagatatctatggctgttcattgctgtgcactcaccgcccactcccagcactgcgcctcactgcttactttccagcacagattagttaagagcacacgctcagcaggctcactgtccattggtacctttcacccttcacaccttctagaaggagttgcctctcaacaggctttggaatcagtcagtctctccctcttaatttttcagttgacaaagtatacttcatcaatgtgtagttgtttcaacttacatacaaattcaatcagtaactgataatattaaagggaactttcttatagaaaaataaaggtgatttattctcattataaaaaaagtacattcttggtatagacaaatctgagaaaaaagacacagagagcaaagaaagaacagttgcccatagtgttatcatctgcacaccaccataatctcagcatgtttccttccaaagagttttctaggcatttgttatatagttgcaatcatgtgatccttcctaatataacatgaacatctttccatattgctgataatttcagtaaatgtaagttttaatttctgcttaacttgtctttatgggcataccttacaatttactttagccattgccctcatgctaaacaactaacaagttttctaatttttcaaatgataaataatacttcatagaacctcttcatgtcatttttttaaaaggcgtgtctttagcacacatttacaggttaaaggacatgccacccccgaccccctttttttttttttttgaggcagtctcactctgtcacccaggctggagtgcagtggcgccatctcagctcactgcaaacctctgctttcctggttcaagcgattctcatgcctcagccactcgagtagctaggtttacaggtgcctgccaccacacccatctaatttttgtatttttagtagagttggggtttcactatgttggctaggctggtcttgaactcctggcctcaagtgatccacccacttcagcctcccaaagtgctggaattacaggtgtgaaccaccacacctggccgagtatgcccatttttaagaattttttatattgccaaattggtttaccaaatggttttacactgatttctggtcttctatcagcaatgtaagagagtcatattcatttcaaggaaacttcatcactattgagtatacttatttttttaatgtgtgaatttagaagtgatacatagtatctcactaatctaaattgtatttctctgattactaccaaaggcaatattctcccatatgtttcacaaattgtttttcctttttttgttgccaatatatgtttctgtttcctaaacttagagtttctcttatctgtataaatttcttatatattgaaatattaatctaagagagttgaaaacatatctccacagaaaaacttgagcatgaatgtttgttgcagtattattcataagagccaaaacgtaaaaacccaaatgtccatcagttgatgaatagataaacaacatctggtatatccatacagtagaatatcttttagccataaaaaggaatgaagtactaatacatgttacatgaatgaacctggagaacattataccaagcaaaggaagccaatcacaaaagaccacatatgatgtgactctgttgatatgaaatgtcaagaataggcaaatccatagagacagaaattagattcgtggttgccaggggctggggagagaagggagtgggtagcgattgcttaatgggcatgggtttctttctggagcaatgaaaatgttctggaattagataatggaaatggtctcctttgtaaatgtactaaaaaccattggactgtgtgcttcaagagggtgaattttatggtatatgaattatatctcactttaaatgaaattttaaaaatattaactacaaggggcttttctatggtccaaaaaggcttgcgggcagggggtggagcctgaaaaaactttacaacctgtgctctaattctttctgaaacctttggcatagatggggttaaaacatatcatccttgttttcatcaccatttcactcttgtcttaaccctgagatccagagcaaaatgaatttaagaagaaaatgttcttactcttttcttggagcctttccatggtttggtgttaaagcctcatttggccatttaggtttgggactggttccagcattcagttgactgcagtcttaaatctcaccactggggtctgatgcttccatttctcttttattgagcgcttttgagtcttcgggctcgagaaatggaaggctatgcagaaaggaaagaacatgtttgttgcagggatgtgagcagctgcctcttagcctgggggccatttgaacaagaaaagccagagatggggacccacaaaaatattctaggtgccagcagtatggcttattcttaaagtaacatgacatttttaagagtgatttatattactttggttcccttgctgtgcggtatgagagaaggttgatcctcttccccctccagagaacctttgcaaagtcatgcgtaaatgatcgaatgggttcaactccacttatttctgaagcaaagcttgggtttgatttttaagtaggctctgttctcccatgattgcatgtggctagtgtctgcattgtgtatattcccacttttacatctatcttctcacctcagagactgtaatattttaatacttgcatttggcgaggggctctccctcacaggcttcaccaagagtagaaagctgttattttgtgcttggtggaggcattatatgtgtatctcagtttatgcagtaaatatgttccagaaagttttgcctgtaaagcaaatcatattttaagtgcaataggaaagctgatttttataccaaggaaaccagtgccaactccttcatggtacttatgaatacccttgccatgactaggaaagatgaggaaattaagggctgcttcagtgtcatcggcccaaatagtcattaatatgccaaaccgcacgaaggaagatggtgactcactgcacctagtatggtccagcatctctacagaatccactgtcttgggggaatggaatgtgcattggggatggaggtgagacctagtccctgaaatcagtgcctccgttagtaatgtatactagtccattctcacactgctgtgaagaaatacctgagaccgggtaatttataaaggaaagaggtttaattgacttgcagttccgcattgctgggaaggcctcaggaagcttacaattatggcagaaggcaaaggagaagcaggcaccttcttcacagggcggcaggacggagtaagtgcaagcagtggaaatgccagatgcttataaaaccaaccatcagatctcatgagaactcactcactatcacgagaacagcatgagggaactgcccccataattcgattacctccacctggtcctgcccttgacacatggagattatagggattacaatttgaggtgagatttggctggggacacaaccaaaccatatcataatgtgtgagatattgagctctgtggaaccaattcttccctataggatttttccctcaacacctccagccctcacacccacacccttgcatggactggccaggattccatggtcaggaaatagctctagtatagagactctgtgtgttggccatggaatcaggctatctggtttcaaatcccatctctatgactgacatagctgtggacaaattccccaacccctcttttcctcccttgtaaagtgtggggaaatagtaatacctgtgttttagagttgttactagattttaatgggacagcattttgcagagtccagcctgcacctaggctacagggaacactgattggatattggtcatgactgctgaaattggagccatcatccccatggtgcccatcccaccaaaacatgtattagttttctgctgctgcctaacaaagtactacaaacttagtagcttaaaacaacatccatctgttagctcacatttctgtcagtcacaaatccaggcacggaggggattctctgctcagcaaagccgaaatcaaatgttagctgattatgttgttgtttgaaggcttgactagggaggaatccatttccaggttcattcaggttcttgaccgagctgttctcagctctgaccacccatgtgtctggccacatagccccttcatctttaaaggcagctgtggagaatctcccccacaatgaaggcctctctcacttttaatctacttttccaggaactggcataccgttcacgggttcacctgattaggtcaggtccacccaggatgatctctcaaagtcggctgtgccaaataacaacccgatgatggagtgactaccccatcattcataaatcctagggatttgcagggcacatacaccgggagtaggagtcctgggggacagctcagaattctccctaccacaatgtcatttagcaaggcacatattttcactccctccagttggcagcaaagagaggactttcccacattggcagagtcctgcatgctttttttcatagctgggctggggccattggctgaacccagcatcagtgctgaaagtgtttcatccctcaagtattaacatctccagagggccaacccagcagtgactttttctctgcttcagtaccttgggaaatgcttgtgatcccaagagtggccagcatagccctgctttctgtccagcctccccagtcctccctggcccttctgtcccgtctgtccccagaaggcagcactgcctgcactctctcatggggtgtcaggatcatctgatgcagtatgctacagaggagaaaagccccattgtaaaggattgaaaggtgctgggaaattaggaaatttgggtgacagtttctgtggcccaacctcattgctgctgatgtggtactcaactgtctctgaatgtccttctgctcccagtaatgacaggggaaaactaaagaaggctttcctaggctttcaatggattaactctctccactgagaatgtagcaaaagtccccaagtagattcttatgggtgtttctaattttgcgaggatcaagagccctctgccatgaatcttctatcctgaagtcaaataatttcagatgtgtctctgccacatcttatccttttcctaatgctattcctgctgactgaaaaagtgtgtttgcttgataagcttccagtttttgcttttttccgagaaaagtgtgaaaccatgcagttgatctgcagttcagctttaaattcttttttcaactgcccccatctcagttgcttgcatttggtttctaggttcttagttcagttcccttccttgttcttatacttccattatgataccaggaaacatgccacctctaagtacgggccaaatgtggctttacctgtcactctccaaagtctgctggaggctgtcagaagcagggattatgcctaagggctgtcacttcttcacacccacctaggttggcttctgagacaaaagagcatacacccctgaaattaaagttatttgttgtcggtttcacttcctcttcctgccattcctcctctgcctgcaagtgtatgtgtctcaagagaaagtaatttgcttgtgcagaagactgccagtggcctttttcccattttggtacctagctcctgcacacacctgaaatcttatcacacgtcctgcaagcttataacttgggcttactggcattgctttattgattggcacatgacgaaatatgaatgtgtctgtgtttaatgtgcatcttgtagactggactgtggtctgtctacatcaggaggagggagtgtatgttcaaccagactcatcttggatcgaagcaccctgtgcctgtggtagtaaaggattgaatctatcctttaggtcagtttccgtcaatcactacagggctatgtggagaagcatatctcccatagcatggcagcagaaagggctgtgatctgttgataatgtctgccctgcttatgggagcagggtgcggcgttccttgaatcctgtgtccggcaattcttcccaggttgcttaacactattggcacatctgtaaagaaccacaggactagggaaattttaaatagatcaagttttatttgcttagtagaaaaagggcccctccctttgcaaaaggattggagaatagaggcttcacagctgtaatccagacaccttgatcacaggcacaggatccaattggtgaaaatgcccttcaccagtttttctaggcatgataacttgcagaagactatagccatgagttcatggcatgtggtattttcctgatcagagtaactccagggctccacattcacgatggcatcattcagtgtttcccggtgccccagagatctatagcaagtgaattagtacattctatgtcacgatgcacttacagcattggacattaaagccacagcacataactctgcataataaaggatacttttattttagcatgaatgatcaaaagtttgccttgtagcaaggagcctgggcacactgaatacagctcatgtagcgtcttctgactcttctgtcacgaagcagttagtctgactgccccacgggggagaaagaagaccacaagttcctacataaatattttcattgtgattaacttttaatgacttgaaactgcatttactgatttattttcacttcttcctatgtgtcattgaagagaaaagagtaagcaagatctgtatagaaacattacttaactcagaatgtcaaatgcgtgaagtggtgatggtgctgtctcttctataaaagaggattgttttctccaaaatgattttgattatttttaatttatttatttaactaatatttattgagtgactactgtgtgccaggcactgttctggccacgcaagatgcagcagttaaaaaaaaacaaaaattcctgccttcaaggagctgatgatttttcttctctattacttcataaaattatagataagctgctagttgcttattatagtatatttcttttttaaagtggattttgaaagattattttttcttagtttggttaaatgtaggatcctgttttcttcagggttcttatatggggcttattttgttttgctggagttggaagagtggtttgcaatgagtgttctcattacttccaggttctgtttctctatcacagtgcacaagcttctagagaaaatcagagcacttcatgtcactctttaaaactgcctgcttctacctaacatgcctgttcgcctgaagaaagcatgatgggttgcatgttaatcacatccatgtaagggaaacagctgttaaactgcttcaaagatgtagatataaattctttccttcgtgtaaatcaggatttcttgaccttgacactattaacatttggggccaggtaactcttgtttgtaggaggctgtcctgtgcattgcaggaagttttagcagcattcttggcctctacccagtaggtatcaggagtatccctcccctctgagtgtgacaacccaaaatgtctccagacattgcccaatatgtctcttgcaggggagtggtaaagttacccccagctgagaaccactgctgtaagtgatatgagtctgtgattcaggtctcacattctctaattacagtagatcagtgaaattcatggaaaaaaagaaaaaacatctgggacaagaagtgttttctgtctggtctttgcagaaatgtggagcaactttccaccacgaaagagttaatattatatgagcaagttatcagtctgatgaagcaacatcaacaacaaatgatgaaattcctttagtacatcatgccttggaaatagcttgcatttcctattggaaacttgttaaaatcatatccatttaccataagttacaaagcatgttgggcacggtatactgtaagttaatctcaaatgatttaggagtaaatgtgttccagatttggtgagctcagctcaagcagtaggcgtctcttttccaaacattttcattctcaagaactgacattcaattcaataagtatttattgaaatgtgtaatatgagagagctttagaacagtctgatactgctcccatcacccagtccagcagaaaagcagtgctcagaagagtgcccagggagcactcttctgatatggcacctcctgcattggtttgcaagatagtatagaaaagcatgccttctcctttgctgcctcaagcccttcccatcctgtgccagctgtgccctccccagtgaataaatgttattacacatgatggcatgtgtttcttatgtgattctttggtcccaaatgggctagtttgcggttttggcagggacctccactggcctgttctacctgacccctgttggcttgttggggtattgcaagtccaaagggggaccatttaaccaacttgtatttctgaatcttcttcacttctcacacacataccagtagattttaaaatgcaaggtacactgctgataaaagtcacaggaggggcctgtcacggtggttcacgcctgtaatgccagtactttgggaggccgaggcgggcggatcacctgaggtcaggagttcaagaccagcctgaccaacatggtgaaaccccatctctactaaaaatacaaaaaattagctgggtgtggtggcaggcacctgtaatcccagctacttgtgaggctgaggcagaggttgtagtgagccaagatcgctccactgcactccagcctgggcaacagagtgagactccatctcaaagtcacaggagggatcggctttaatacagagagggtaaaagagaaacataataggctacagaatcttcactcatctggttgctatttattgttccaggcactggcaatgtagctgtgatgaaaacagacagggtcccgctttcctggaacttgcagtccattgggcaatgagacaaataaacaggccctgttttaatatggcgccaagggtgccagaaggagggagatgaggatgccatgggagcacttcagaaagcacaacccagcctggaagggcagggcagtcggagaacgccttgcagaggaagcggtgccttattaactaggacatggatacgtcacatatcaaagaggaaggggaaaaagtgttcaaggttatgttccaaggcccgaagcgggtgggggaatggagtctttgaggatctgagaagttgggcgtgtttgaataggagagccgagacaggaagagtgggaagtaaacaaggaggaggaaatgaggatgcttctcaggatgctgactggagcaactgggacactggtggtcccatttacttagatgaggagcctgggagaagagggtttgaggagggtggggtggcaacaactcgagtttttaatccgccactaactctgtaacatgggaatgatttttttttaatgtttttgaaggatgtcaaaagctaatggaaatttgaaaagttaattagcagctttaagtgatttcattactgtagactatcatgacatcctgcaaatatactctgacctcttaggttctgccgattttatttttcatccagtaactagttcttagttttgatacttagcatcatcttagtgcttaaaattgaccagttttgtgcctgaagatgtggtacccatgagtgaagcagtctagtgacttgattgaaggttgtattctggcttatccaacactcctgtgccctcttccttaaatttcctgtgccctgatggaagtttttattctaatgttgcatagactcattctacagagcatgtattattttttttagatggctaaaggcagaattggtaaatatgattggaccgtctgtaggcaggtgtatgctgttacagaattttacgagatacaggccttattcgaggaaagttgctgcatggtgaacattgtgctccgtgatgatgctgtcatccagaacatatggggaacaaatgcgattgtggggtcaaggaactgaacttcctcctaaccatctccccagccactgcctttcctcatgccccctaataggcctgaaatagccaacagtgagccttgtcaattactcctcgtttactgtagagcaacccagcaactagggagcatcccagcttacgtgcccccttttttgtctttggcaggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggtaagcccccaaagtcacagagtgcagagagggggcagccacccttaaatcttttggcaattgaacatctgggttcccatcacttccctttgactaggggtttcacatgtaagtttctaatctgtctcctctactagatgaggggttgtaagaaaagccagagtttgatgtacaaacaaaatgcttggctacagggttgcaaggtgccccaagttgctgctttctgaggattctatatgggttagtgagctacaacattctactgaggcactgtaggtcaatgactctcagcctcacctggctggttggcacagaagaactagggcagccttttcaaaacacggatgcctgagccatgtcccagtcttttgaattagaggctccaggactgggtctgggtgtgtgtattttgagttctctagatattaatgtactccctcttcccactcacttcttcctaatcctcagcctgcctttcttttttttttttttttggaagtttccttgtctttcataccacaaggctatattctgctgccatgtgtatttgctgacttagctaatactttgtaaaatatctggcgtacgttctcagacatatgttttccgaaatatttgtaagttatgtcatgcatccctagtcatccaaattttctctgagtatgtgaaccatggtaactagatatttcacattatttgttccagaattattttgtttattgcaaaagtttgaaagaatgcagcatctctcagttcatctggcagcagatgtcttatataaaagtttgaaagaatccagtatctctcagcccatctggcagcaggtaccttttcacctagggaggaggcactactaaggcattagcaagttttttttccctctgcacccaacacacatcacacatcagtgtagttgtatcaaggagcctgaccctgagcctttggacattatctacttctcttctgctagcatagcacactctgcccagtagaagaagtatttatgttcaccctcatgctgtggtgactctagctttccttttaacccaggccttgcatgggttgaatacgtgctaagtacctttacccatccttcccaccttcccaaaggtgcctgaagagacacagacaggcagtctaaggccatctgtcttctgatgatgcaggagaaaaaaagaggcaaacacaacccccatccttgtgcctaccgtgagaagcataagggctttgccagcccagactgttaattctactgacacagccattgtccttgttcattcattcacgagtgctggatatggacccctgggtctgcaggtatcattcattaaagtcactagagagggccacttgtgttgagcatgtgggtctccaccgtagtcaggaggagtctttgtttaagaggctacctgatcccttataaaatttgaaagttaaaacacagtactcccaaatgttggcagatttttctgccttgagttatttggttttaatatatatgcatgtcctttctcccaatactgccttcagtcctgtaaggccaagaacaacgtctgtgtttctctgtaacctcctttgattctcccctcagctcctggaacatggaacataaaagccctcagtgagaacttgtcagctgatgcaaggagagagtggggtgctggtcttcatgtgccttgccttccacacagtggggctggcttggcttcatttttaaattgtttttaaagaagggaatctggtcatggagtgttaaataagaataggcatgaccttacgggcacccacatttttgttttaagccaatctcttttcttacctttcaaagaaatctaaggaaagaaggaaagttgccaaatgagcctagctttgcatggtcagacctctgaatgctaactctcctgaggaaagtcccacttgggatggggcagaaagacaagccccactcttctctgtggtccttgaatagtgccatgacacatttcttcccttggaactacctacacagcaaattggcagcttggtaaaaaaggtggactctggccgggtgcagtagctcatgcctgtaatcccagcactttggaaggctgaggtgggtggatcacttgagcgcaggagtttgagaccatcctggccaacatggcgaaaccccgtctctactaaaaaatacaaaaaattagccaggcgtggtggtgggcgcctgtaatcccagctactcgggaggctgaggcaggagaagtgcttaaacccgggaggcggaggctgcagtgagccgagatcacgccattgcactccagcttgggcaacaagagtgaatctccatctcaaaagaaaaaaaaaaaagtgggctccctgtcatttctgtaggtcatagcaggcactctgaagtgcagagagaccagaatgaaaaggcagactgcagggaactactattagttatcaactgctgtataacaaattgccacaaaacttagcagcttaaaacaaaacacatttaatttcttttttttttcaatttcagatgttttttattcagaggttcttaaaagaaataaaacagaaaagctaacagtctgatcaaacatacagctcaaaaatgtcttttgacgtttaacaacaagtcctaggaaagaaaactacagagttatcttgaatggggtaaataagttaccactggcaagtctgtggcactagtaaaacaaaaataaaaaattaaatctcggccaggcgcagtggcttacacctgtaatcccagcactttgggaggctgaggcaggcagatcacgatgtcaggagttcaagaccagcctgcccaacatggtgaaaccccgtctctactaaaaatacaaaaaattagctgggcatggtggcaggcacctgtaatctcagctactcgggaggctgaggcaggagaatcacttgaacccgggaggcggaggttgcagtgagctgagattatgccactgcactccagcctgggcgacaagagtgaaactccatctcaaaaaaaaaaaaaaaaaattaactctcttgatcatatagatatctctatatctctttttttcaatcgggtacaaaagatctttcttcataattttttttataatttaatggctatctactatatgatgtttaactaattttttttttaatatacagaggttatgtttcccaaatcttacccagacgagtatggcacttagttagacatttctggcaacagatttcccctcccctctaaccaaactatcaaatttctgccttaactaatgcagaagtatcaactagtgggagacccaggtttataactgtactaggtacacagagggtgctgcgttcagcctgggctttcacaaagcagtaatattccagggagcatagaaccagtgataccgtgacttttaaaaaataaaacaaaaacaaatttatcttatgactatgtaattttcactagaatctacacttctcagagcagccaggactttggaaactatgaaatgtcactgacatttatcatcaaatacaagcataaaatgtaagaactaaaaaatactcaaaagaaataactgcttagccctagcttctgagctaggaggatttgggctgtggaaacagggagggccagcaacctgtcccagcacaaaagaaaatagactctgaggtagataactgatcatacacagctgaccagacaagtacacagttttggaaggcaacttaatttaccattgcttttaagacatatgcaattgccttaataaaagagctttaataacagtgtattatcttatatgtactaaaatagaaataactgtgtatttatgaatcaggaatttcatagtttcaaaactggttttctttacacttgaacacttgtagtgatgacataaagtgtggcaccgcttggatccaaatcttccttcatgcttttttgtttatgtgtgtccatacatcaattaaaattataaaacctaaatttacagtttctgtgggtcaggaatctgcgaatggtcagttcggtccttcagaatctctcacaggctgtaatcaaggtacgttggctgggctatagtcatctcacagtttagctgagaatgatctgcttccaaactcatgtagtgctggcaggattcggtgcctcgctggctgttggccagaggccaccctcagttcttggtcacatgggcctcaccagcatggcgccttgcttcatcaaagtacacaagctgaagtggcaatagagagagtctgctagaaagacggaagtcaccatcttttgaagcctagtcacttaagggactgcacattctgttgagtagaagcaagtcgttagatccagcccacactcaaggggaggggcttgcacgagactgaatactaggaggcaggagtcactggggactatgctagaattatgcctgttgggttgggcacagtaggtcacacctataatcccagcactttgggaggccaagccagggggatcacttgcacccaggaattcgagaccagcctgggcaacatagtgagacccccgtctctatttgaaaaaaaaaaaagaattatgcctaattatatggaggaaatcctaggccaaatgacactggatattctctgctgctgctagcaaacttctgtaaaccaggaagggcctctctagagagccagatgagaggacatagggtgggtgtgaggaagagtgagtgctacaagacagtgtgaggagaggtgagttcaaggtagggggaggacaagggagagggttccattttcagcagtggggcgagcagcacaaaactgcaaaatgaactgcagatgccaagggcagtacatcctctaattggggtgaatattacagaaacggtcttctctaaatttccccaagctgcaggaggcatttcctattacgttctatgttactgttttaccaggagaaagggtggtgcattttacccagaaactaacataggctccaagtggaggagaagatacgaccagcaaaggatgtcagtaactgctgcagagccctgcaaacctgaaccctgacgctgacgctgcccttttgtttgggatgcaattttaatatttccctgctcctcagccctcattaaaagctattacagaaagaagcccttcaggtctaggtttctttcagatacagtaaggcttcccctacaaagaccaaggcataaacacagccctgtgactgtggttttgacacgttaattacaacacttcatcatgttattagtgctggctagatgtagattgtgagaatgagattttagtgaagatttaatttcttggaattaatttccccttgtgtaataatctcccttcttgtgaatttcgtttcggcaggagtgacactctttgtggccctttatgactatgaagcacggacagaagatgacctgagttttcacaaaggagaaaaatttcaaatattgaacagctc

SEQ ID NO: 209 - DNA, 18014 bp, Homo sapiens
gccacttctaccatctgtgaaatgagggatgggagggggaacttgaggaagtggtattagatgatcattaatagtcctgtcagcatattattgtagggttttatgaatattataattgcattttagaccataataaccaaacattacatattgatatatttaatttttttatttaagtggtacatgatcagcattgtccacatttacaatcgatggagaaacagtgaaattcagtgttatgttaatggacaactggtatcttatggtgatatggcttggcatgttaacacaaatgacgtaagtctttatttttctctctgtgttttaatttgtttgagagtatgatctatcattacaaaatgaattgaataataaaatagtttggtagaaacttaaaactttggaagtttattctttttattaaacaaatctttcactgttaaatttaatataagaaaattgctaaaagacatgattagggatgcaaaaacaggaacatttggccaaagttttaagttttttagataaaaaaccgcgaatcctgtattctatttattccagcatcaagcactaaaaaatgtggtttaccccttatttagatatagaaagaagaccctaaacagaagtgtaacatatagtcactattattaattacatagtgataaatgctatggagaaaataaattggggatacagaaagtgtagttgtagggaaggggggagccggatggtccagagatgattttagtaggaagaggtgaacaagcaaggtatgtggggaacttcttctatccagtgggaacagtgagtgtaaaggctttgaggcagaataggaaagttcaaggaaaaggcaatttgtctggagcagaggtaggtagaagcagaataatattaagagataaggttaggcagaaatcattttggccttcataagcaaacataaggcctgggcttttgcatcttactcagcttaaaaatccttggaaggttttcagcagacaagtgatgtgtgcttatattttaaaagcatcagtctgcctgcagtattgacaatattttgaagggaaattacagaagcaggaaaatcacttaaatggcttattgcaataaaacaaagagattatattagtttctaccagtatgttagcagtggaagaagtgacacagttggattctagatagtgaaaaactcgaattaaaacctcaagtgtccttacggtttctctactttgggctttccattgtctacattctggcctgtcagagccaaagtaaaaggtttgttttaatgctgaaagtacctgcaagctcaataatatacaacccttcacgcttacctggttttataagaacttacctcttaaatacaattcatttttcagttttgtttgcatgtctataggctttaatctcccaaagggcagggatttgcttatcctgtcttgtattcttttaactagcactgtgtgtatggtccataggttgtcccctagatcggggcttggcagactacaccctatgaaccaaatctgaccctccccctgtttctggtttcgtgtaagctgggggcaaagactcttggcttttaatttttaaaggttttttgtttgtttgtttttttcttgagatacaaacaaaatcaaagaagaatgggacagcaaccaggtgtggcaagcaaagtttaaaatactttctgtctgtccctttgtagaaaaagttgcttttccctgccatagaaactcatggttgtgccacaaccaattaatatttaatggaatgttgttttcagaattagaatacacagatgaaattctgctttttatcttctctccagaggagatcttctctccagagtctttttattatagagtggaagaaatcccagtggtcttcttgactcattcaatgataagacagtatcttggaaagaaaatacttagttttttggttatttataatagtgccctaagaagtggagaattctagataataacacatatatacatactttatgcagttaaagtttaagttcctatacttctaattaaagattgggtatttaatgatgacagttctttttgcctttgtacgcattcacaattttttttgttactttattgaagtaccaaaagtacttcttacatatataattcttgcttattcattctaaggtgtgaaatagcctttggggataggggaagggaactgagccatgactgctttccctggtttgggtgagtggggtgtaagaagtagaggctggaaagatcttgttaagcttttggcttcttcagtgctgaattcctcaatgtggagggcactgtaccatctgctttaagcagcagattttagtcttattgtttatttgattctgtgtagttcctactcatatatgagaggggatttattttctttgtgtcttttactaaatacggaggaatagaggaatagattcataatttcaaaaataaaggagaataaaaaaattagaccctatgtgttcactacattttggaatagtcattcccttgattcagatcaatctctctatatatggataattatacatcattacagttttaaattattttaatgtttgtaaataattataagctattttgtctttaactataatatttgaaaagtgttaagtcagaagattgagtagatggctactgtttgcttaaacataagtgtaaaaaatgtaattgatcatttttcccaaaaaaacttggctggcatttattatttaaataataaagtcttcattgatgctctcctctattattattgttatattttaaaatattcataaaggttgatttaaggatttaaaccttttcatcattaaaaatgatgcttttttaatgacttttataaatagagctatgacaagtgctttcttggatcatcagaaactgctgatgcaaatagggtattctgtggtcaacttggtgccgtgtatgtgttcagtgaagcactcaacccagcacagatatttgcaattcatcagttaggacctagatataaggtagtaataactataattttataaattctatggagcatttcagatgtaaaatgtgatgtaatataatttttagtgaaaatctttctttaatacagtttaagagtcatttctattttttggattgtagtcagtttttattatgtgtttctttttggttcaaagatgcttttttctcaactgttttctctttataaacttttttattcttcagaatattttctaatattgatagcatgccttttgttaacagttctgaaataataaatcttataaaactattttgcttaatgtagtatttataatacaaaaatttgaaatatatatattacatagtaaacataataaagaacttgttaatattactggtaacttggaaagaagagttaaagatttagaaggaatctaagataatatacttcatgggcctaaaattatttaattttagtttatatttttgctttaattgcagtgaggaagtaggtacagtagtgagtaaactaatttagcaaaactaattatttaatgtaatttataatattctttctgttttttaaactttaagaacaaagactctaggtaagatatagcatgcacatatatgagttagttttaaatgtgcagtacacctggataggggaatatataaaggttctgtctaaatcacattgggaattgtgaagtctcaaactacttggagctgaaagagaattacacattatagtcaaagtgtttataattctgaaggagtacttgtcttgtatggaagtgtggtttatttattgaactcaatttaaataattaatgtgaagattgtgttatggaaaggaaaaatatttttaaaaattccctctttggcctttgtatttttgcattggtatttctctttttgtttttatgtcatacacacacacacacacacacacacacacacacacacatatatagagagagagtgagagagagagagagagagagagagagagaggaaagtttgaatttacccatattaaaagatctttttttctcagtgactttaataaccataataatattgaagaataataatgctattatttttatgtcaaggtaacaatacttgctatcatatattttccatatcatttttgtttttgtcttactagctctagaaatgaatttgtgcttgtccagctatttcttctttcatgggtctttgtgttgggtttgcatcctggttcttccattgttgatcttgcataggaatatttttgtaattcacattttttattaatatgctgcttgcttttctttcctacttctttgagttgtttcataaaatacttgcagtgtctttttaagctctaatagaatgatattaaatagagtgacaagcaaacaaataaaatataaaaaggtagaatatcaagaaaatacaaatccgatatgattgctaatgtgaaatatcagaattgatgggagcttcctggcaacatcaaggaaaaaggctgaatataagcgattttgtaattctattcacaaagaagcaaactttgtcctgaacagctttgcaaactctgtagtttgtagtattcttttcacacgcctttctcgtcattctttttaacaacagtgataatgagcagtaacctggtcatcatgtgtgcacagctcatgtgacgtagagtattcttagtatcctaacacacaatagagtacctaaagccagaacttttaagagatatacctgtaagtttgggcattacatcagatagtattttattaagttttgaaagttctcagcttactgcacccttgttgttagtgggggttgatcataaatccacaggtacatgcattttctcaatttgtaaatttttttttgaatgtatataatttttatttgttaactatatctcaacaaagttggaaaaaatgaaagagaagtgaaggagcaggaagagcaagatggagagggagaaaatccaataaagagtccacaatgtaggttgcagctgtgaggatgcctctcagagctgaagggaaaaaaaagcacacacacaccagctgccatccgccactgcctgagagctgtccctaggagtattaattaactcccttgtgtttcttcttagctgtgcctgcctctatctggggctgaaaagggcttctgtttcttaccaaaaaaaaaaaaaaaaaaagaagaagaaagaaagaaaaaatcctaaggccgaaaaacagagagaggaacagagggtgattgaggtggggtacaggcggcatgcacacagattcttcaccacagcatagttaaagtcagaagtgggcccaggagaagaatggaggacatggaaagcatttgcattggttcaccttcacatggcttggatctacagaggctacctgataaactttgtcacctattcaaagaggtggccagcataatccctaacaaacacacagtaagtagtaggacaagcaaacatcccactgcacagctagtaccaaggtcaacactagactttgtcctctcccccttcactccccgctttcttccctcagccagacctttagctgctctgggagcttgccagattagatgaccctgcctttcacctcttagggtctgagtacctttggtggctctggttagttgctgcagttgcatgttgactattgtcactgatgatgggagcaccaagaggtgatcccactgaacacaagttctagattatgcctccctgtccctgctccctgtaacaccatctctagctactcatgatgattgtggttatttctcctggctactcactcctttctttgagggttgccctaccagcatgaggatcccaaagtgaccagagttgtaattgtatcttcaggttggttgattgcttaccctgtccttggaatctgagacctctgatccagcaaaacctaaaatagtggagctgggactcgtaaattctgcaagtggattactaagagttttaataaaggacaccaattgtatttccactctttgttcccagacccatgttgttggctattagagaccagctataggagaccacataatgttattgaatatttactgtgtatagactattttggagaacagagctacctttgtaagtgtatcatcctgaactggttttttagctgagcctttaataagtcacttaatatagattatggtagaaaaaatgagtcccacagtcacatgccctctgtcacacttctactgctgaataaaatgagtccctgagtccgagatgatgttattcaggatcccatgtcagtaaaagtagataaatttgtaaatattataagtacaattgcaccatgacaggcatcagcaaaatttttttatattaaaaagctttttttttttttttttagaaattcagagagcatagagaaggaggaatgcaaatgatcgggttgtgttttgacagaaaagctgagtagttcacacattatagttacaattatcttggtaaagtcactctctgtgagagaaggggtagagggctacagtggaatttttaaggtgtagagaatataataactaatggacatttggataaatcacaaatggagattacttagtgttgtataataacatagtatttatatttattgccttaagttatatggaactttctttcattgtaatggtcagacaaaatttatgattctgagtttagtgtaggtagcatgtcaacatatgggcttcaaagttaataaaataagttaattctaccttcaaataatgtcatcaaactatatattcaatagaacctgtcacaaatgattttgacttgttggtcactgtagtgctaggtaaatttttttctgttgaatatttggatttgagcattgcagcttatcagtaagtattctgtacttggttattttctggaaatggtaaataagttagggtatcacttattaactaaataaaccattcagtttggaaaatacagaaatacagaaaatatttaaaatacagaaaatctcactgtagatttgtctagtatagtaaaatttactaccacataagtttactgtggatctctatttggggttatttaatgtcttcaagattctgtatgaggtggccctttgacataagcttcaaatcagattttaacaaaggttttatattttataattattactagacattttctcattgttttgttaatcccgtgtagcaagcagttagtcttcatggccagatatttgaaaatttagttttgagttctctctttcatttatgaatatgatagcataatggtttttataatttgctatatcataataaagttctaactgataagagaaaaagtataacacaacctccaaaattaaaaatcacttcagaggacttccagtacttgtgtggaggggtgaactcctaacaaactgatcttctcacaaataaccatttgtaaactctgcacataatatagataatatctatctgagggttgtggagattgaataaaagcaggcaagcttcggagggtagtcaaaatatggaacagtctgtctacatggactgatatccccattttttgcttttataggaaactttctggctagaaagtttctctataatattgtacagagtaatagtcacactatttagcatataatccaaaagtacttattctaaaaatggtcagaaaaaatgtgacttattctcaagggaagagtaaatcctcatataccaactctaagataacccacatgttggaaatatcacatgaggtcttattgtaactagcgaggtagagaaaagtttacttataatgaattaaaagataggaagtatcagccatgaaataaaacaaaatcagatggcaattctagaactgaaaaatatatcagaattaaaaataagctgtatgggcttattagcagaattaatattatagagaagtaaatgaacttgaatatagattgacagaaaatctgaagagagttatgaaagattggggtgaaaaaatagaaccctagagatgtatgggggcagttttgaaaggtctaataggcacagtataagagaaagagccagaaaaaatatttgaataaatgatgatagaaaacttctcagatttgataaaaggattatgtttatagattgaagaaactctgaaaactccaaccaaaataaatgcaaagagaaccaaagtaggcacattacagtcaaagtgtggaaaaacaaagataaagagaaaaccttgaaagcaggcagaggaaaactagatactgataagggaacaataatttgaatttctgtacacatctcatcagaaagcagggaagccatagaggtggaacaaaatctttaaagttctgaaagaaagaaaaaaaatctgtcaacctagaattttttatccagtgaaaatattctttgagtcttttgaaagaaaatttaaaaaatttgttgttatttgactctcattactgactgaagaagcaaacctggatgattcagagtatataaatgtaatacatatgataactagcagaaagatttggagagaggctataaatgcacctatgtagttgaaaagttacgtattttgcaatgtgtcttgatagaatgatgttgactacaattcaatggctaaaacaaaattatcaaagtcaaaattgcatgtcttttcttgaatgataggtatgtatccagtatttcatttacccacagcatatgctgtagacccctctttcaaattaaagataacaaaagcccaattgaatggaaaaacaaaataaatcaatgctaactaaatacaaataattagccttcactaattcatccattcattcttttattaaacagttgggcactgttctagatgctagggatataacaattaaacaaaaccaacaaaaaccccatgcctgtatcttggagaagtagggtgtgcagtatcatgggagaagacataacaaaacaaaagaaaaatatatagtgtctatatggtgataagagctgtgagacacacaaagcaggtaagatggaagttgaggctagtcaagtggatatccggttaagagctttaagggtaaatgccagagcaagcatgaaggccattagcagaagcttacttcacagattaaagaacactgtgactatgttttgctgtgactgtcacagaaggagcaagggggagagtcaaagattaattcagggaacaactatatgctttcagaggattgttatgactttatttttgctcttgagtgagagggacagccattgaaaagttttgagtgtcctggcctgataccaatttgaaaaggatcacactggttactatggtaaatagggagaaaaggtggaaatagggagactagttagggggctgttgcagttatttagtgaaagagctctggaaagtattgagacttgattagatttttgataaagcatatctaaaatatctaagactctaaaaggtcagctttggggtatactttgggggtagtgccagtaggattttctgtcactgtgaacatggagtaagggagcaagagaggattgagaggagcaagtaaccccatgaattttagcctgaacaactgagctgatggagttgtcatttactgagatgggaggactatgaagaaataagttgtggcggagaagatcaaatattaggttatggacataggttacgggcatagttgtttgagatgcctgataaacatctaaatggaaaaatgaagtaagtctggagtttagaggtgacgtctaggttggagatagaaatttggcattggcaggatatggacaggatttaaaggtaaaggactggatttaggtaccaatgaagtgagttcagagaaaaagataactgagaaatgagtccttgggaaagccagtgtttgtaggttggggagatgcagaggaaccagcaaaggagaaagaggagagcaagggaataaggagaaaaagcaggagagtgtggtgttttaacttgacctacttgaagttaaatctcctttcttcattgaggatactgactgtcaaatacacacaggataatagatgagaaaatcccataattatacataaagaacagcctcagaataataataccaataatgcccaattgttataattactgaaaatgtagttaatttgtttttgaatgtgttctcttcattctccctcttgccatttttaaaatagttgaggcgttacaaggtgaattatgttcccctaaaattcattaaaattctcaccctcagtagcctgaaatgtgactgtttttggaggcgggtctttaaagaggtaattaagattaagtgaggtcattttggttattgggtcctaatccagtataactagtatccttataaagaggaggaaattaggactcagacacatgcaaaagaaagaccatgtgaagacacagggaagaaaaggtagttaggctgtcttcaaaccaaggagagagtcttcagaagaaaaccctgcttacacccatatgtcagacttacagcctccagaactatgagaaaataaacttattttatttaagccatccagactctggtactttgtcatagcagacccagcaagctaatacaaagtcttatctacatagtgagcacaacagttattacataccattctctcttaactgttatttaatcatagtcctataagtacctgtgtgtttagggcttatattatttccttatattgatgtgttttggctgtgttttagctctttctgtagtagattcctcaggaagagttcatggaaacagtatttcttgagaaatgcattttgatactagtgtgtaaggcactttatattttttacttgaaagtcattttgcctggttataaaatccttgacttttttttctttctttggatgtcttaaatatgctactaatttttccctagcatgaggtattagtattgaaagtctcttgacaatgtaatatcttttccattacaagacactcagtcttgttagatgttcaaaggatttttttttctttttccttaaatctagtaattttggtagacatgtcttggtgttggtcattctgagttaatttctcaggtatgtggtgtgcactttcatatgtagtttccatcttttcatattttaagaaattgttcttatactacaactttagaatttcttctctttccttgctttggttttcttctccagagacttgactatgcatgtttatttactttgcttatctttttcttaaatcacttattttatttcattttctcttaaatctttatctccttctttctctcacattttaaaatttaaaagtaaaataaaaactacagaaaagctacaagcactatgccagtcagtttttttcctgaaccatgagagtaactactgacatgatgctccatcattcctgaatgttgtgttcctacaaacaagaacattctttcacataattattctataacataaaatcaagagattagcaatgatttgttactaccatttaattatcagacccctttaaaattttgctaattgttgtataatatattttatagtaaaaagatccagtttactgcatttacattataatgcatcaaacagcttctcagtctttccttcattttctatatggatgccctcttcacctgaggcaggtgttggcttcttttctgattaccttccatcatggatgccctcttaacccttcctcagttctagcacaatacactgagctaggctgttgagctgatgccttccctatatccttctggagcccccggtttctttacctcctgctgggcagccctcttattcagatgctaccctctctctagaactcttgacaacccatcctggcttactcctttgggcaatgtgctctctgccctgctggtggtgtgccttcccttgcctggttgcttccctttgtgcgtattttctcatcttcctcaggctacaacaacctgagccaggcaaccccctgtgaggatgcccttctctggctgcccaggctccaacatgccaagccacacaccaaatgaatgattttcaatccccactctagatccagctgccttccatggtttgccctctcctctcaggcagatgccttctcatccttttcaggctctgactctacacagagaagcccttagtgtacctaatcttccttaccttgcacatactcagaaactttatgtcaaggcataacccacttgcctcttccttgttgtttcaggtagacgccttatcacttttttggaattctgacttcatgaactgggcagctctcctacctacccttcctatccgtcttatgctctgacatcctgcaacaaattgcactatgttgttggctgtaggttttttatagatgctttttttggtagttagaattccattctattcctagtttgttcaatgcttcttataaaaagtgttagattctgtgaaacatgtttagtgtatctgttgagataataatattaatatgttagtcagtctaggtacaggcttgttagtagtgttgatcttttcaaagaactggcttttgattttattgtgttttcacagttgttttcttattgtctatttcattaagttcttctataattctttttatttttttctttctgcttgttttatgtttagtttgcttttttgcttccagggtcataaagtgggaggtttagttgttgatttgaagtcctctttttaaatacaaacatttacacgtagaagtttctaagtgccttaactgcttatattttggtatttgtgcctttattcatctcaaaatactttgtaatttcccttttgattatttcttctttgacacatcagttatttaggaatgtgtttatttccacatatttatgaattcctcaaattcccttatattattgatttctaacattccagtttggacagataatatactttgtattatatctgtcttcataaatttattgaggtttgttttatgacctgagtttggtgtatccaggagaatgttttgtgtgtacgtattttttggaaacagggtctctccttctgtcacctaagctggagtgcagtggtgcagtcctagcacactggagacttagactcctgggctcaagtgatcctcctgcctcagcttcctgagtagctgggattataggcacaagccactgtgtctgactaatttttcagctttttatagagacagggtcttgcaagctcaggctagttttgaactcctggcctcaagtgatcctcctacctcagcctcccaaagtgttgggattacaggcgtaagccactgagcccagctatgtgtactttagaagaatgtgtattctgctgttttgggatggtgtgttctagagttgtctgttagttctgtttggtttttgttcaaatcttcagtttctttcttgatcttatgaatggaaagttgagtattgaagtgcccaactattattgttaacttgtctatttctcccttcatttcttcagatgtttcttcatgtattttgacactctgctgttaggtgcacatatgtttacaattgctatatcctcctcatgactgacccttttatcattatccaatgtctttttaatatctagtaatatatcttggtttaacatctattttgtctgatattagcacagccattccagctttcttgtgatttattgatatttttcccatttaatttactttaaatatgtttttatctttgaatattctataaacagtatgttattgaatcttactttattatccagtctgacaatctctgccttttgattggattggttatttcattcatctttaatgtgattattgataggtttccatgtgtcattttactttttgttagctatgtgtctcaagttctttttatttctttatttcttctttactgctttctttggattatgtgcttattttcttaaacagcattttcaatttttaaataatttttttcacttaaaaaaacatttccttagtgattgcactagggcttaccatatacatcttaactcactggaatcagcctcagatttatactaattttatcctagtgagttatataaatgttacttctatatagctctatttgttttctccgttttttgtgacattattgttatacatatagtatctgtatatgttacaaacccaacatgacataattatcacttcatataattgtgtattttaaagaagctgagagaagaaaggagatacagtatatgtttgtagattttattatattgatcttctgatttatcatttatgaatcttttcatttgtttctgcggattcagttaccacttggagtcatttccttagctcagtataactttgcttccacccaccttctttgttatgctgaagtggtccgtattgaaaagcatgcatcatactctactcatttgagtataattggtacaaaatatattcatacattcttttcttctcttaaaataattataacagttttattgaagtgtaatttacatgtcatacaactcattaatgttaagtgtacaagtcaattattttttacaaacttacaaagttgtgcagacatcactacaatttaattttagaacatttctatcaccccagaaggatcctacctgcctatttgcaatcactcctcattctcatccatgtcctattcatacagttttatataacaattcttcctctgaaaatccttctgaaagaaataatacaataaatattgatatttatataaaggcttatacttttatgtaaaattttttctttttaaatttttttgagagtcagggtctcactgtgtcacccagggtggagtgcagtggtgtgatcaaggctcactgtggcctcaaaatcctgggctcagtgatccttccacttcacctcctgaagagctgggactataggcatgtgacaccgcactcagctaatttttaattttttggtagagatggggtctctctctgtgttgcccaggttgatctcaaactcctggcctcaagtgatcctcccaccttggcctctcaaagtgctaagattacaggtgtgagccattgcgcatgtccacctttatatataaatttaaagacatagaaataacctaatactacaaataagggaagataagaaaattatctttatttaatggatttcatgtttatatttaaattacattatacactttttttaacctgaaaatgttagatttaattacgtaaacttgttttcctcctacaaaccaaaatagggtatggtatgtatcatggactcagaaaaactaagaccaatgtatttccaaataagaataggttttattagacaccttacatttccacaaaagtattttaaatcttttaagataatatattaaaacttgttaattccagtgtaagcagtatgaacaaaatgaaagcaagagttttgttctagacaatgggatgtacaaatgtttccgcagtggtaaaatgcagacacggaaagctgatttagtgtttaacaacgtatcttgtgtgtttaattcagtcattgtttttttgaatgcagatatgctgagttcttaagcattctagtgataacactaccttcctcattcaaaaaaaaagtattatcaatgaaatacttcagactacaacatacacagatttttaattattcatgttgctcttgtcttggcacatgcctaataattaatagtttgcatccagtttcgtattagtctctacacactagtccagaagtaaaaactgacatgtttggtcttcacagtgttaaaatgtttgaattaaattttaaaatatagtgcttttagataaaaattcggatttcatgtttctcttgaaaaatatggaagaactagcaacagtgaacaattgacttgagctgaggagtaggggccacttttagaaaggacaaacattctctagtttgaggaagtccccatctggcccaattcacttacatgcatatctgtgtgccttctgtgagaacttgagtttgggacatttgatttaaccttattataacattgagtgagaaaattggagccacatcagctaaatgatttcctaagcttgaaaaagataattagtggcagagtcaggattttaagttgatgtcagcagcaatacactgaatatggactataaatcagaagacttagaattacatgctggccccttcccttctacatcttaatttcttaacattaagctttcatagttgtaagttgaaagtaatagtaatattgatatgtgattattgcaaaggttaaatatcatttatcattattagactcatatctgcagagcaattttaaccatgtctgacaatacctttcttgttatagatggcatatgtttagttgtctttcataaaaagtaataacatgttttaacaaacttctcttctgagtttagtatgtatattgtgatattattgttgagtagcattggtatttcatagattgatttgctttttagtgaagatatgaatatttttgcatattaactttttatagcctcaaatggtagtcatttttataagtaattcatgtgtcaggcactgcttatttacataaatactttttaaagtgttaataataaaaattaaacttatgctatgatgtagtcaagtaaaatcctattatatataatatcaggtttgatatttttttctaatgaaatgattttgccagtaatcaaaaactttaaattagaaaatgaagatctgagcatctttattggcataataaaacttaactctcattgaattgaagtgacaataacaaagtaagtaacaccactgaatagtccctgacacatgaaaggtacacaagtactttcttattgcaaatgtttctctgctttaaaacttttaagttttaattgttgcttttaaaaagagtgtttaccttggttttattttttcagagtaccttcaagtttaaatctgagagtgatattcatttggcagaacatcataaacaggttttgtatgatgggaaacttgcaagtagcattacctttacatatactgctaaggccactgatgctcaactctgcctggaatcatcaccaaaagagaatgcatcaatttttgtgcattcccaacatgctctaatgcttcaggtgggtgaatcatggctgtgttttcatgttcttgtcagaatttaacagtatctttattttatgtatcaaacattgctcatctataaatctgtgactttttgtttcttttttggcttttgcagatcttttaagtgaaactttaaagaatgtctatcttttctgtagcaatatgctctaccctggccttgtctccttagtaggaaatctgtcatatctattatcttatatattatacagcctttgaaattaaatcaattaactgaataagttagttgttagatataaaaacatactttgctttaagattgtattactaatattctgtaacattaaaattacttgtctttaaatccatcaatagtatttctggttttaaaataacatttgattttaacttcatatttttagtgtaaaaatgtctcaacctaagatttgaaatttaaaagtgattagcaaatgtactcacttttttgtcttatgtgtgtataaaaattataattgaaggcttcaaaaatgtccaactatgttatttaattcccttataaaggtatttggaccaaggaaatagtgatgaaaatcattctatagaagtttaataaacatttttggttttagacataggatgtgaaagggatagtaacacattcaattcatagtgcaattcattcaattggacagattcaagtgctttttccactgtttccccaattggataatcggcagctcaatgacagtcaagtggaaacaactgtctggtaagttttctttacatgtgcaattgctggtattttatacacacttagactatgcatgatgtactcagtgctgtgtaaatgtat

SEQ ID NO: 210 - DNA, 21605 bp, Homo sapiens
gagccgccgacggggcgggtgggctttgctgccgagcaggcggcgccgtcttggggcctagcggcgaggcgacccgcacaggtgggcggtggcggtaggtgggtggccagcgactggcaacgcggtggcttagacgcgcgagatccggccagggtcagaggtgagcgggccgcatcccagagcccgctggaggaagacggggtccccagagacccggcaggccggggcggaggttgaggcagctaaactccaggtggacgcctacatcgcctttcgcggtgttgctaagccgaacttttaattttagtttgacttttgggttccagagacgggtatttccggacactggcaagaattttgccttgcgtgtcttcgaaggcggttttcttggtgtccatattgcataaaggcttgtcgctcctctgtggagatgacggttgtacaggtaaagcctaagttgtgacaaaagctcctgcaatgggaagactctggtcgatcagggaaatcagtagaattgatagcaacgcgtagaattgatagcaacgcttagaattggattaattactggccatggttacccggcgctcagaaatgaacttggagaacagttgccctggaagccatctcccgtagccactgcgtagtgggggccgcgtcttcttgagtgcaattcatcaaagtctctagtaggactcaaaatataaagtgacgagcaggattttcggagtcgagtacagtgtacttgggttgatcaccatgttataaagttagatccaaattaagaaatacatattcgtctctgagcagaattgggtcctttttttaattgctttgctttttttaaagaaatgtaaaaacagatgccggtttgattagtttgcaggttgtaatattggaagggacctaagattggacacagagttctgaattctgatctaggtctgtgatgttaggaaagtcagttgttctgattgccttattctgtaaaacggaaatgataatgattacagtttcctcacaggttctagtaaattctgtgtatagacagaatgtttgctttgtgagagatatgaagttattagtttttgtctgaagtacttaaataatttaaagttagtaagcccccatccccaatttagtgacaagaaatcttaaagtcatcacattttgtccgaaaagtacatagtgtatcttcatcttcaaattcagtggtcagaaaattttcacgttcacctaaattcaacttaaacctcctacgagcttttcaagggtaggagtaatatcttactcattgtaaatgatcgtaaatcatttacagttgtatggtgcttgtgtttgtgttgtattaggaggttagtccattttttaaagtttcagacggagtttcactcttgttgtccaggctggagtgcaatggggcgatcctggctcactgcaacctctgcctcccagttcaagccattctcctgcctcagcctccggagtagctgggattacaggtgtgtgccaacacacccggctaatttttaatttttttagtagagactgggtttcaccattgttggtcaggctggtctcgaattcctgacctcaagtgacccacccgcttctgcctcttacaggcctgagccaccgccccagccaacttttttttttttttttttttgagacggagtctctctatgtcgtccaggctgcagtgcagtggcgcgatcttcgctcactgcagcctccacctcccaggttcaagtgattctcttgcctcagcctcctgagtagctgggatttcaggtgtacgccaccacacccggctgatttttgtgtttttagtagagacggggtttcgccatgttgtccaggctggtctcgaactccagggctgaagcaatccacctgccttggcctcccaaagtgctgggattataggtgtgagccactgcacccggccttctgtatttttttgtagagacactttccccatgttgctcaggcaggtctggaactactgctcctgggctcaggccatctggcagcctctgcctcccaaagtgctgggattactggcgtgagccacaccccacctggccctttccttttttttttttttttttttttaatggcttggcaaaaaacaaagctttggggttcaccaaaaatcaaagcaaaactgttttacctggaaaatcttgttttctgtcatcagaagttgtgctttagttcagctgtgtagacacccagtagtggttacatgaagttaggtgaatagattaaaaataatttttatttgtcatcagtctcagagcaaatgttttctatttatttttatttctaacttttttttttttgagacagggtcttgctcttttacccaggctggagtacagtggtgtgatcatggctcactgcagcctctatttcccaagcttaagtgatcctcctgcctcagcctaccgagtagctgggacctgtgccaccatgctggactaatttttttttcttcccttagtagtgacaagtctcactatgttgcccaggctggtctcaaactcctcagctcagatgatcctctcacctgggcctcccaaagtcctggggttacaggtgtgaaccaccatgcccagtcttatctcagagcaaatgttacgcaccatcctttgctaggcagagtgagcttcaaccctggcagcacgtttgactcgtctggggagctccaaaaatggggactgtgcctcactctagaccacttaatcagtctcaagcaggtgggtcacaggcatcccacagtttgaagctctgcaagttactcttgtgcagccaggataagaactcctgtagttatagaaaagaagattttctttttttttttttctttttattatactttaagttttagggtacatgtgcacaacgtgcaggtttgttacatatgtatacatgtgccatgttggtgtgctgcacccattaacttgtcatttaacattaggtatatctcctcatgctatccctcccccctcctcccaccccaaaacaggccctggtgtgtgaagttccccttcctgtgtccatgagttctcattgctcaattctcacctatgagtgagaacatgcagtgtttggttttttgtccttgcgatagtttgctgagaatgatggtttccagcttcatccatgtcactgcaaaggacatgaactcatcattttttatggctgcatagtattccatggtgtatatgtgccacattttcttaatccagtctatcattgttggacatttgggttggttccaagtctttgctactgtaaatagtgctgcaataaacatacgtgtgcatgtgtctttatagcaacatgttttataatcctttgggtatatacccagtaatgggatggctgggtcaaatggtatttctacttctagatccttgaggaatcgccacactgacttccacaatggttgagctagtttacagtcccaccaacaatgtaaaagtgttcctatttctccacatcctctccagcacctgttgtttcctgactttttaatgatcgctattctaactggtgtgagatggtatctcattgtggttttgatttgcatttctctgatggccagtgatgagcattttttcatgtgtcttttggctgtataaatgtcttcttttcagaagtgtctgttcatatccttcgcccactgattgatggggttgtttgttttttccttggaagtttgtttgagttcattgtagattctggatattagccctttgtcagatgagtagattgcaaacattttctcccattctgtaggttgcctgttcactctgatggtagtttcttttgctgtgcagaagctctttagtttaattagatcccatttgtcaattttggcttttgttgctattgcttttggtgttttagacatgaagtccttgccctcgcctatgtcctgaatggtattgcctaggttttcttctagggtttttatggttttaggtctaacatttaagtctttaatccatcttgaattaatttttgtgtaagggctaaggaagggatccagtttcagctttctacatatggctagccagttttcccagcaccatttattaaatagggaatcctttccccattgcttgttttggtcaggtttgtcaaagatcagatggttgtagatatgtggcattatttctgagggctctgttctgttccattggtctatatctctgttttggtacaagtaccatgctgttttggttaatgtagccttgtagtatagtttgaagtcaggtagcgtgatgcctccagctttgtcttttggcttaggattgacttggcaatgtgggctcttttttggttccatatgaactttaaagtagttttttccaattctgtgaagaaagtcattggtagcttgatggggatggcgttgaatctataaattaccttgagcaatatggcgattttcacgatattgattcttcctactcataagcatggaatgttcttccatttgtttgtatcctcttttatttccttgagcagtggtttgtagttctccttgaagaggtccttcacatcccttgtaagttgtattcctaggtattttattctctttgaagcaattgtgaatgggaattcactcatgatttggctctgtgtttgtctgttattggtgtataagaatgcttgtgatttttgcacattgattttgtatcctgagactttgctgaagttgcctatcagcttaaggagtttttggtctgagacaatggggttttctagatatacaatcatgtcatctgcaaacagggacaatttgacttcctcttttcctaattgaataccctttatttccttctcctgcctaattgccctggccagaacttccaacactatgttgaataggagtagtgagagaggtcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagcgttgttgaatttcgtcaaaggccttttctgcatctattgagataatcgtggtttttgtcatgggttctgttcatatgctggattacgtttattgatttgcgtatgttgaaccagccttgcatcccatggatgaagcccacttgatcatggtggataagctttttgatgtgctgctggattcgatttgccattattttattgaggatttttgcatcgatgttcatcagggatattggtctaaaattctctttttttgttgtgtctctgccaggctttggtatcaggatgatgctggcctcataaaatgagttagggaggattccctctttttccattgattggaatagtttcagaaggaatggtaccacctcctccttgtacctctggtagaattcggctgtgaatccatctggtcctggactttttttggttggtaagctattaattattgcctcaatttcacagcctgttattggtctattcagagattcaacttcttcctggtttagtcttgggagggtgtatgtgtcgaggaatttatccatttcttctagattttcaagtttatttgcgtagaggtgtttatagtattctctgatggtagtttgtatttctgtgggatcggtggttatatcccctttatcattttttattgcgtctatttgattcttctctcttttcttctttattagtcttgctagcagtctatcaattttgttgatctttcaaaaaaccagctcctggattcattgagtttttgaatgaatctttccaccaaatattagaaacatatgtacccaaggagtgaggtttcgttttgtttttgtttttgttttttgtatcaaataggctagataatgtatcttttttttttttaattttagtttaagttctggaatacatgtggtgaatgtacaggtttgttacataggtatacatgtgccatggtggtttgctgtacctatcaacccgtcatctaggttttaagccccgcatgtgttaggtatttgtcctaatgctctccatcccctttcccccaaccccccaacaggccccagcgtgtgatgttcccctccctgtgtccatgtggtctcactgttcagctcccacttatgagtgaaagcatgtgatgtgtggttttctgttcctgtgttagtttgctgaggatgatggtttccagaatcattaatgtcactgcaaaggacatgaattcattcttttttatggctgcatagtattccatggtgtatatgtgccaccctttctttatccagtctatcattggtgggcatttgggttggttccaagtcttcattattgtaaatagtgctccagtaaacatacgttacgtgtgtatgtgtctttatagtagaatgatttataatcctttggtatatacccagtaatgggattgctgggtcaaacagtatttctggttctagatccttgaggaattgccacaccgtcttccacaatggttgaactaatttacactaccaccaacagtgtaaaagtgttcctgtttctctgcagcctcaccaacatctgtttccagactttttaatgactgccattctaactggtgtgagatggtatttcattgtggttttgatttgcatttctctaatgaccagtgataatgagctttttttcatatgttggccgcataaatgtcttcttttgagaagtgtccgttcatatccttcacccactttttgatggggttgtttttttcttctaaatttaagttctttgtagattctgggtattagacctttgtcagaaggatagattgcaaaaaattatcgcccattctgtaggttgcctgttcactctgatgatagtttcttttgctgagcagaagctctttagtttaattagatcccatttgtcaattttggcttttgttgcaattgcttttggtgctttagtcatgaagtctttgcccatgcctatgtcctgaatggtattgcctaggttttcttctagggtttttatggtttatggttttatggttttatgttgtaagtctttattccatcttgagttaatttttgttaaggtgtaagaaaggggtccaatttctgttttctgcatgtggctagccagtcttcccagggccatttattagatagggaatcctctccccattgcttgtttttgtcaggtttgtcaaagattagatggttgtagatgtgtggtgttatttctgaggcctctgttctgttggtctgtatatctgttttggtaccagtagcatgctgttttggttactgtagcattgtatagtttgaagtcagacagcatgatgcctccagctttgttctttttgcttaggattgtcttggctatacaggctcttttttggttccacatgaaatttaaagtagtatttcctagttttgtgaagaaagttaatggtagcttgatggtaatagcattgaatctacgagtacttagggcaatatggccattttcacaatattgattcttcctatccatgagcatggattttttttctatttgtttgtgtcctctcttattaataagaggattttttatcagcagacatgattatatctgtgatttgtaaagtgaactggatagtgatcaagcccagtgggcaagctattaaaataattcaaaggaaaaatgagaatagcaacagtagtgatagagaagagattttaaaaaatgtattttttttctctctggagatgttaagtatttttgagaaaaggagtaataattgtaacttggcaagtgtgttttgcctttcctagttgaaactacttttcagcagtgagtggataggttgtggtacatgaattttattgttactcattattaaaaagtgtcttaaaaatatgtatgtcttaaaaatataagtaattttccttgttaattatgaaatatgtaatctctttttttttctcttaatagccttatgttaatattggggttttattgtttttgcttttcagtactgtaagattgatgttaaaggcatggtgttcaccccacttcatcagcgtacataagttatctcttcttttggacccttattttatgccataatggtaagcttcagctcagtatgttcaaatttgtgttttagaatgttctcttccttcatcttcataaagatatttgtatggtagatatagaaatactcttgtaagctgtacaggttatcccaactgggaaattacttagcaatcccattgcaaagtcttctctataaagtatattgctcactaatcagtgttacagtgatcacattcatccatctatctgtgcttgtatttatgaagtattaaaaatatttacctatatctactttgccatattccaaatcgttggcaaggaggatgggtataaatacaaatagttttggggagtatagatttctcgtattttaaagcttttctttagattttattaaaatttaaaaacaaatgtaacctgctaactgcatataacgtatttcaggcagcatcagtgctaatcttctaatggcacatttctgttcactgacttacagtcactaaacatagttaggagtaggcatttaacttttgccattaagaaatgacagactaagggagaaaaacactttttaatgttttaaagaagcagcagcatttgacagagaataaatgaacattgaccaccatgttatttatttagataacccctattctgcgtcacaaacttcagaaaacatctgtcttccttctcctcttggttcttgcctatctactcctcccctattagagaaaagtagaagtatcacagtggggttctgacaacaccttgtattttgcatctatattacctaatcattttcctcttaagtttttgaaggagataatgaatgaatgatgcttttatttatgtatgtatgcatgtctcactagaccctttgaagttttaatttcagaagatgaaatatttacttgagatgactggctgtttaaaattgtcctagactatatatatttgattttgtttattataattttttgatacaaacaaattttatgggcaaaatttaaaagaaccttctgtatttgtgaagtgtatatgtacagaattatgttttcatggtggaacatgggatcagggaaaatgggagtcaggaatcttaacttgaatcctgggaaccagtttcattgggaatccgcttcttataagtttttttttttttttttttttttggtagtgacagaatctcactatattgtccaggctggtcttgaactcctgatttcccaccttggcctcccaaagctttggaattacaggcatgtgccacagtgcctggccaagattttttaacaaagcaaattagtgtagatttattataactgaacgttttgaaaagatggcagatttcagactttgttcacttatcatatttagatatttgataatgtgggttttttattgaacagtgcaagaaggcccactatttttggaattatacaaattctccatccttaggactaggtggtcacttaaaagttcccatgatttccaaagggtggcagtatttgtttttcccccttaccctcctgggactttggtgggtggtaggagtttttacccacatgcaatttggtaggttgaggtattggaatctgcaaaataagacagaagaatttaagtccttttaaataaaaactgaaagttctgtgcctcttaataaaatttaaaaatgactatcattatgaatgaaaaagactataaaacagaaaactagaaagaaaaccactggtggtatatttgggttttgttttatttgtttgttgtttttgttttttttgagatggagttttgccctttttgcccagactgtagtacaatagcacgatctgggctcactgcaacctctgcctcccgggttcaagtgattctccttcctcagcctcctgagtagctgggactacaggcgcgtgctaccacgcccagctaattttgtatttttagtagagatagggtttcaccatgttggccaggctgatcttgaactccttacctcaggtgatcctcccgcctcagcctctcaaagtgctgggattacaggcatgagccaccatgcctggccatgtttaattttgtttagaacctagtacttttattcatatgtgtctttagaaatgatggctttacaaatgaagacatagcatagcttcaccatgttttttcctcgtctctaaaaaatgaacggatagggatctactagtagatctcaaaccttacatgtagtaacagtaatatatttcatcaattctgaggttcattttcttttatattttaatattactgaattgatgatgagttgatactcaagaatatcttagaattgatagcatatttttttctgtcttaatgttatgcagaataatgatgcatgctttcaatggcatcttgaattcattgaaacatggcaatgatagccatcatttattctttctaggcactgagctagagatgttgtaggtttttttcattaatatattagcaatttctaagttaatgttaagtgccagtacaaccgcactctcaattttcaagatttttagcagatgaggagagtttagcctttggttcattttgattgtatactttatggccagtatatttttttgaatggtgctcttaaaaattaatgtctatgaagtgatgatagctgccatatccaaacctcccctatattagcctcacaaacactgaccagagagaccgtgtaagcattcttatttagtttgttgttagtaatcaggtgcccaagactcatattttttctttgttatatatatattgatcatagagtggagtggaggagacaaataaaggaaaatatattagacctgttttagaaaacattagaaatgttaaatgtatattaaatttttttgtggaaataactaatattaccaaatatactatttactttttacagcaacaagctttagaactagctttggatcgtgcagaggtgaggtgtgactaagttacatattgaaatagtgttgtctttaattgacaaaagctcagttttaagagatttttgtatgtgatttttaaaggagcacattactattttaggacaagtatgcatatcattttgctgtaaatatataaaaataccaggtgatatttggatcacctgttacttggaatcctcaagataataatgttacagaataaaacttacttgaagaaggatatagaatttctaaaattgtattttcctgttttgacaagttttctaattactcaaaggaaaaaatagctaaggtatacagtatacaatttttcatacagtaagcatattttgaacaaccataaaatatattgataatatttctgacctgtgaagtcatggttgtgaaactatgattttgcttatggcaatgaaatactctgctaaatcgtggtgcagttcaaatttcatttgtttgaaacttatctttagatgttaagtagtttttcctacaagatgtaattcagagagttaagtgaatagcctttttagccttacgtatgttttagatatactcaatacagttgttcatagtcaaaagcaaaaagcaagctgttctcataaacttttgttttttagtatgtcattgaaagtgcccgacagagacctcctaaaaggaaatacctatcaagtggaaggtatgaataattaattggtaacatcttagattcattgaaatatgatgatagctaccttttattgcattcctcgtagggactgagctagaaattttataggttctttgcatgtattaggaatttctaagttgatgttagctactatattcagctccaccccagtttttgggaaattgaggcaaaaatgtgaaaatttaggaaaaaattaaataacattcatgtcatgatgattactctgttaacattttatatatttgtttcattaaatttttttagaaaatctgtatttcaaaaactttatgacttgtatattgaagaatgtgaaaaagaacctgaagttaaggtaagtatacatttttattatgttgtagcttttgaaatgtagaagagaggaatttggaggagttacatttggagtattatttttgtgtgtgtgagtgaactaacatcttttttaacctgaccctagtcaattctgtagctgactcagagctctggctaatctggcaccaggcagagatcacctgctgaggtaggagtgaaggaacagttatattgagtatcagactgtctcactaggaagtcataagcaaagccacagtatatattatcttttgcttcttcttcccccgagaagtgatttatgagtttatagcacttcctcctgagaagttatttacagatttatagcagtaacctgttttctcatgatgatttaaactggaaagccagagctattacagagcatgtatgaaattcaagtacagtaataaaaagtgagcttggtcataaaccgagttcatggccaatttaacttaattcatttttatttggcataaagatatgggtagtagacatgtaacagaagtcgatttattgatgtcttggagccctcgggttggaagggtctaaacgtctctatgagcttttgttgtctgtctttaaaaatgaatacagttttactatttaggccaaaaacagtggaattccagtagtgtctaactttaaaatctttacattaggaaaaaaattatttttaaacttataagtaaatcttacagtatgtttttcataagttctactgatacatacttgacatacaataaattgtacatgtttatagattttttaagttttgacatgtgcattatagaaacacctcatgaaaccatcactacaagcaatagaatgtacatattcatcatgtcagtgacagaactaaaataagagagctacatatatgaagattctaaattggaattggcaagccactctccaccagctaaatgtggcctactgcatgtttttataaatgaatttttattggaacccatcacacctgttggtttgtatgttgtctaggcctgcctcacaggtacaaagacacattgagtattgcagcacaaactatttggcccacaagcgtaaaatactatctggcccattaagaaagaaaatttgcaacctctagtctaaatgggatcaactctgtggtagctaatttgttttgttgaagaggtacacatactgtaaaaatttatctaattctgtcttaagtcaaattatgagggttttctctacactgaaaagactaacattttaagtctctctttactagtttaacatcaaagtggttaaaagttgtttgcctttttaaaaaatgttcagattgcttagtgttttgattctatggtgatgacagattaagaatttatcacttctttctgtatgtgtgtatgatatatgtttaatatatatttactaaatataagatattcaaaacactttgatttttgagattctaaaaaaatttactgttatttttgctaaataagatttgatgacatgatttgttaaatctgtaagtaggtaggttttattttaaattataagcatttttaaaatcatggactttgttgtggtttttaaggagctgttgaattggatttatagaaaatgtccaaattgcttacttcgtcttaccaattagatatttttaggttcaacatttcagcttagagctgttgaacttgtttgtatcttatttagcctataaaatatttaagaaatgtgcacttcttagatacaaccaaagagaatgccccaaattctttaggttagacttctacttagtggaaactgtatgcttctgtgttttatatatttgcatttaatggttttatatactacttatttaaatatttttatttcttaagtattcaaaagtacttgttttatatttaagtgcttttattgtgttataggtcacccatttttaaaatatgaattaatttgcataaaacatagtagtaaataaaaattaagtttacatagctgtcccatacgtagtggctatagttttgtgagccttctccatttattcagaatcataatgcagaaagagcaccaaaaggttaattcaagcctgattttgttaaatcatagcattatttgttaaggttatactggattattttcatgagctctgcctctttttaaagcagaaattaagaagaaatgtgaacttgttagagaagcttgttatgcaagagactttgtcatgtttagtggtcaatctatacccaggaaatgagggatattctctgatgctcaggggaaaaaacggatcaggtaagaccctctagagcacagctgccacaaaatacttttgctaggcaggatgtgcggtttttttaaagtagttttttaacctgctaaagcatttgtccttcagatagtgatgacctagtgataaaaacagattttgatcccagttttcttccttatgatatgttttggtagaatattagaaattatctctcttacaattatctttcctgaatgtgcattttagaagtattctaattgatatgtctttcaagtccaattataaaagcatctcagaaccaaaggaaaggttaaaaaaaaaaggaaaattatagaggcataacttacagatgattaaaatagaatttcctttcattctattgctatttatattttaagatagcataccgtgtttaaaggtaggtagtcctgcagtttgaacatgagtctgaaatcttcaaaattaagcagactcactgccttttgagtaattttcacatattaaaatatttctattaatactgaatatgaacatttctgttaatggtgaatatgaaaataatttaaaaatagaaacacttcagtttcattaaagaggtgtaaaaatttaatatgatgataatgtgaattctacaaggaactcacatagctggaattttgtgtgtgtgttggtaattaattgtaaagtgtaacaccaagagaattttgttctaaaagtgaccacttttcagataaggcaccaaattgtccctctgatttccagattagattaattggtcttcagtgaactttcagttactttgacattggaattttatcatattctgattattttgctttgggctgtggttcagattgtgacgttatgccagatgttttttcataatgtgttaggttttttttttcccccttaagaaggacattaggagggccttttggttttgttttttatttttattttttttgatccttgcttggttgaaatgccttttggttttattatatatagttctttgaaaagccatttgaattatacagctaagctttcagtgagcatgatcattttcaaacttcatgttttaaattaagattccgagaccattcgactgccctatgaagaaggagagttgcttgaatatttggatgcagaagaattacctcctattttggttgatctcctagaaaaatctcaggtacaaaatttttgtctttaaaatgtctttatatttgttatatgtatatgatatatatatgtcacatttttatgtatgtatacatatatgtatataaacgactacatgatgtttcatgacagatgatatttaatttctatcactgttcccaacagcctttagaacatgaaatcaggctgggctttggtggctcatgatgcctgtaatcccagcactttgggaggctaaggcaggaggatcacttgagcccaggagtttgagctcactacagtctcaaacccctgggctcaagtgatcctcctgtaccactgcaggattagagaaggaaggattagagaaggaagaggaaaaccagaattgcagtgattgcaccactgcactccagcgtgggtgatagagcaagaccctgtctctaaaactaataataatagaagatgaaatgagacatatatagctatctggaaatgggcttattgtcggatatttaacctttagggtatactgaaacgtagagacgtagttcttctaaaatagttagaacaattagctcatcaattggaaatctccctatagttacaatcaagaaattatgaaagaaactactttgaatatttatgaagtttttcacttgggggccagaaactggcctttacatctgtacttctgttcatagcttgcctaggtaagcactcccttgccctgttctactttcttcttactgccttaacttaaccccagccatactgtgtactctactgaggaaaaagaagacatcacatgagaactctcgtttcctcctagcaccagtcgactagcatccctacctctctcttcatatctgcctgccttcccgttaaaatagttgatgtatactgtttatagacatccatcccctccacttgttttctggatcctccccttccttctcaaggacttaaaattataacctctctttttttctatttctctttctctattaaatgcagaatgcaagcatactgtgttacaggttgagcatctcaaatctgaaaatttgaaatccacagtgttccaaaatctgagcactgactgacacttaaaagaaatgctaattggaacatttccgatttcaggttttttgattagggctgcttaacctaagtataatgcaaatatttccaactctgaaatgcttctggtctgaagcacttcagataaaggattcttaacctgtatgtctcaaattttaaaaaaatcctcccttgacctcatatccttctccaactactgctcttgttactcttgacagccacgctactcaaagaatttatagtcatttcctcttttgcagatcccattctttccaccacctatctcatttggcatcatgacatcgttctgcagaggctgcatttgtcagagttaccagtgatcttcatatactgaataattggtcacttttctgttctcttcttaattggcctcttagcaaagatcagtggatataactgcgtcctgcttgaaatgcctttctgttgacttctgagacatcattttcctggttttcctctgctttctctaatccttcggtcttttttactataatccctgttccatccataaacatgtgtgttttcaggttcagtccttggctctctgtttttctttagtaatattctccctgaatgatttcagccagtttcatgggtttttaaaatgttacttagtctattgcttatatgcctcaccatggccattccaccaagctcctaacttacatattttcttggatatataataggttcctcaaatttaacatgacaaaaacagagctttattttacctcccaaaccagttttatcaccagtctcttcagtctaacagatgactctgtccttaccttccacattcagtccatcagcaaatgccagtctctctttaagatacatgatcgtgcccagtgctctgaacaaaacctttgctttcctgtttgtcttcatcttctagatctcatcctcactcgctgcattccatccatccttgtctcatttccacaataaaacactccaagcttgttcctacagtaagaacttctcatatgttattccctctgtctggaatgatctgtccctgaagtgtctggccgtttcttgtgattcagatcttaggtaaaacctaaggtttctatctgcacatacaatccagattagcccttccctatttgatttcctttatagaattcatcactatctaaaattactttgttctgtttacatgtttattgcctgtcttcccacaactgagagcaaatgttgtctgactactgtatctgtgaagctgtacctggatagtgcctagcacatagtaggcattgtagttgctcagtaaatatttatttaaaagaatgacaataagaatgacaaaacatggagaccacagtacccactaaaagttctgaatgggtgaaaaacatactatgagtgaccatggcaagtcataactagcaagacttcgatgataatagttcttacatttgagcatagaaaggactgaaaaactatttttctttttttttttttttgaggtggagtctcgttctgtcacccaggctggaatgcagtggcccaatctcggctcactgcaagccccaccgcctgggttcatgccattctcctgcctcagcctcctgagtagctgggactacaggcgctcgccaccacacccagctaatttttttgtatttttagtagagacgcagtttcaccatgttagccaggatggtctcgatctcctgaccttgtgatccacccgcctcggcctcccaaagctgggattacaggcatgagctactgcacccagcctgaaaaactatttttcatttgaattttatatttagcttccctcttattaataaaggctaagggcaaaattatatttctgaaaattttagcagagcaaatatagaagttatatctagaagctaaaacactggcaaggttggttggcaatttataacaatgataaactttatagtaatgacaaagttagtgaaatgtaacagtaagcctgtgagctgcagaagaacagcagttccaaggatctgtaacataatagtatgtaaatgccaaaagtcaaactgttgacttggtagatgccaaagtcaatctataattagaaactattaaatagttttaaattgcttcttgtgtcatagtgatgaacatgaaatacttcctctgaaaaggtttacatagtgttaaatctaccaaggaaatctactgaagagtacatacatgagtggccagaaatgttgcatgaatgtaaagaatgcgaaatgtttgatataaacccacttatttaggcttttggaaaaaaaaatgacgtttacgtatttttgcccaaacaggttaatatttttcattgcggatgtgtcatagcagaaatacgtgactacaggcagtccagtaacatgaaatctcctggttaccaaagtcggcacattctcttacgtccaacaatgcaggtaaggatgtttaattaagaaatactattttagattttagttgggagttttatttatcgaattcttcatatgtttgtgcatagattaataagttttttaaatttttatttcttctagactttaatttgtgatgtacattcaataacaagtgataaccacaaatggacccaggttagttgttttgttttttaatctcaaacaggcaaaatataggatgaaaaaaaattatcattaagcaaaagtgattttctgcttatttttattcaataattaagtttgatgctttatgtgaaaagctggtattcctttataagatctagaagttaagggtctctttatatgtgtagtaatccctcaagttgcctaagatcattttaaggtcaagctggcctaatatattcaatgagataaaacttagttctttatctcctctcaaacagaagaaaaatgttttgtttttaccatggttacaaatagatactggttttttttttcaaataattcaagtttctaaaccctagcctagcctatctttctttgccatttatactggttgccttgaaatgaggggaactctcttacccctgagaataaccagttaacccctccagttctggctcagtgttatatgaggggacttcagaaagtttgtggaaaactggaattaaaagataataataaaaaatataaacttttcttctcaatataagctccatcaagttcaagatgcttgtaaatgatatcaaccatttatttagtccacccctgaagaactgagggtcctgggaactgaaccatatcaatgcaatcttttctacattattaactgaagaaaaatgggtactttttaaactttttttttttaagattaggaaacaaaaagaagtcagaaggagccaaatctggactgtaaggtgcatacctaatggtttcccatcaaaactcttacaaaatttctcttttttgatgagaggaatgagtagaggcattgtggtgcagaagtctctagtgaagctttcccaggcatttttctgccgaagctttggctaactttctcaaaacactcataataagcacgttatcattctttgttccttcagaaagtcaacaagcaaaatgtcttgagcatcccagaaaactgtttccatgatctttgctcttcatctgtctgcttttgctttgactgaatcacttctgcctcttggtggccattgccttaattgtgctttactatcttcaggattatactggaaagaatgctttagtatcttggtcctacttgttgaaaatttctattgaaagctctgcttttgcagctgatcgggatgcagtggttttggtacccatcgagtggaaagtttactcaactttaatttttcagtcaaaattattcaggctgaaccagttgagaggcctatagtgttggcaattgtttctgctgttaatcattggtcctcttcagttaggttacaaacaaaatgaatttttttcctcgtaaattgatgtggaagatctgctgctgcaggcttcgtcttcaacatagtcttgtcccttcttaaaacaagttacccatttgtaaactgctgctttctttgaggcattcttctcataaacttttcaaaaagcatcagtgatttcacaattcttccactcaagcttcaccatcaatttgatgtttgttcttgcttcagttttagcagaattcctgttgctctggtaaaggctgttttcaaactgatgtcttatccttcttagtgtttcaaactaggttctgttcagacatgttataacagcttagtacatgtttattttggtgcaaaaagttttgaaacctatgtatagttttttcttaatactcatttttcataaactttttaaagaccccttgtatatgagatgtccactcacaaaagtgttcagttgcctgactatagtgaggaataattactaagtcaaaagaaaatatcagtaatggtagttatcctttctgtgacatgtgattataaactaagcttcagttcatcagtaactaccaagtattgtgttttggtttgggctataatgttgtcatctacaaaaagattaaaagctattaaaagaatattagaaaacagaaaaactcattggttaccatcagagtttgctagggcatcagattcttactctgaagattgataaaggagagaatataatatttatcctgcccttcttgttatgaactgtattttaggcagccaagtaactgagggaaaattcttaggaaaatttccagctaataggtgcaaaagaaatgatagacttttaaaaaataaaagtttgaaagtcttaatgaagtagtgaatctagacagcagtatttcttggatgtgaaaaccattagatgataggttaatgggaaattttataatgtagaaatctgatcaaacccactgattgaagatgagacagtcaattattgtgtacctcctggtttgatgcaagagacagtacacaacagtagtaatagtaccaataaagaactcttgtccaaaaaaaaaaaaaa

SEQ ID NO: 211 - DNA, 123431 bp, Homo sapiens
ctggagggaggagctccctggggttttactctaaagggtggcctggagcacggagaaccattaatcatctctaaggtatgtttctttttccaatattgcctttattcaaattgtttttttcaacttgtcagatttgtcaaaaatgcaaaataatgagaactgccttaatataacttaatttgctgtttcatgcctttctgattatctagaaatattttggatagcctgggatttgaaagaaaaatgtgtctagctcatttattctatgaaatccgaagaaaaatatgcctgtttgatggataatcttctctttttgtgaatgaaatcgcatacaatcagttaccacatgagcttttcagttataaatcagattaaagattaataacatggttaagatggtggcatggtatatatttgtgcattcaaaaatatctgctttttctctcttcaactgaaaatagcatctaaaaatattttaagtttgcttataattctggataatagattgcataaataccatgtgttgctttttttccccacactcagaaaggagaattaaatcagctttcagcataactcaagatcaaaacatttctgcctctcctatttatctgtatatttgaatccctttttaaaccttagtcatcctgcagcatacctcaattcttcatttatcttttggtgtgggtagtcataccaatgaaatatttatgtactggggttaatatttctatttttctcttaaactacagattaacattacttgttataatattgcttttaaatttttagagtatttaatagtctgatacaatagattataatggcttttcacacatgtgcattcatcaagaaacatttgtaattaagggagaaaaaatttttaatttgagggtgggaagaaggtaatatggattgcatttgagctctgttattggttcaggttacttttcatatccccagaaataattccaaaaggttatttttcaaattactgaagtaattcttactgtggatgagccagggagaactgggtttcacagtgataagccacgagtgcacgggacaccattataagttgtatgacttttccttaactttcttaagtaaaacaaaaggatgtgcatatgtgtgtgtcagttaggaaggcttccccctgtgaaaaaaattcaaaaccgagtttatagtggctctcagtaaattggggtttgtttttctcatattacaagaagtttggaggtagattttccaggcaaggggagcagcagctcaataatgtgatcaaggaccccacttatctctccactctgccattcttatgatgttggctttgtcttcatggttgcatgatggatcccacaactccagcattgattgcatcttcattccagacaggtttttggctttttgtttctcattagacctttgctttcatctcattaaccagaactgtaccctgtgcctgtctttaggccaatcactggtaagaaatgccagtgattaatacagactgattaggatttctttcacaggtttctacaataaggacctactcttcctgaagtcaaggaatcattgcccactgtttgaatgatttgaggttctttttgcaggaagaaagagggcatggttgctgaataacagataattctgcaatgaacataaatattgtctcggcatttaaaaagtctagttgtacacaatttgcctgtcccttaatgataaaatattctgtatctatacactacagtatctgacagtttgctgacagaaaggtctaatcctcccactaatgagccagcttctctaagcctccattttacctgcagaatggggctatcctactatctactttaatgggttgtgtttaaatgcaaccatgcatttaggttagtgtctagtacacagaaggagcaaagattatgattattgcttttcattattctagcagacatgtgtagtaggagacaggtctggctgctgtaaaaagatccaaaataacaataatataggaatttatttctctgacataacagtctgagcataagccaaaccaaaagatggctctatgatgtcagggacccaagttccttctattttcttacttccatcctggagtgatatctcatcttcatggtccaagtgacttgccaccacatctgctttccagtcagtaagaagcagggaagagggaaaagagaaggcaatctcctttctttcaaggatccaatctggtccaatgtgctctgtccaatatggtggcccacagtcacatgtgactatttctatttcaattaaaggtaactaaaatgaagtaaaaaattttaaactctgtttaaatgttcctcatttgcacttgttgcattccaagagtcgtactgttccgaagctcttgaacatcttcccccatgttgtctgtctggcaaactctttaaagctccatttcttcttctctctgaggttttcctgatgtcacccaagttgagttccgtggtctcccttctacacttccatattatgcatgtattacattgaatcataaaattttatttcgttgattgccttctcagaagtctgtgagcctttttagggcagggactattttttttttttcatctctatcacatctaaatcagagcctaggtacacaaatgtttgttgagtatatgaaagggcatggctgtgtcttactcattttgcattttcaggatctagcacagtgcctggcacagagtaggcactcaataacttttactgaattaataagcaaaagaccaaacagaaccaatgaggatgccaggcagacctccatgtggggcatgtattagtttcctattgctgctgtaacaaattactacaaacttatggcttaaaaacaacacaacttacagttctgtaggtgacacacctcacacagatctcactgagctaaagtcagtgtgtcagcagggctgtgttccttgctggaggctctaggggaagatgtgttttcttgccctgtctagcttctagaggctgcccacattccctggctcatggtccccttcctccatcttcaaagtctgcaacagcaggttgagtccttctcaccctgcagctgacctctgactgcctctctctttcacttttaaggcctcttgtgagtaccttggacctaccaggataatcctggataatctctctattttaaaatcagctggttaatagccttaattgtatttgcaaccttaattcacccttactaaataacctgacatattcacaggtttcagggattagaatgcagacatcttaggggagacagggcattattttgcctaccaccaggcatttgagcattggtagaagtctatgtaattaaggcagtaccagggatgagactaaagtgaaatgtggtggctgatcatgcgtatactagatcttctctctaagacaatgaaagaaaatgcacattagctcatacactgctaaccagatgtctactattctcccaagttagggtgaccctccattgtaggggaagggaagggatagtacacattgagtcacacatatgaaaggcacaaacacattatacaaggcagctataaactgccaggttatggatggcaatataataaatgaagtatcatttttctttagatataaatgaggcaggagaatgaatggccgtaaaggatctacaaagggtaacaatagaataaatcatttttgaattgctttctttgggatttaatatccttggaaaggaaaggtggggttgtggaaagcgcctctgtaatctgtgaacttcaaaaagaaagggtaacttttaaaaaattgtcattgtaagtggatgctcaggtaattcaatagtccaggaagttggtggcatgattttattatgattcacttactctgtattgtggctcagaaaagcagttccacctgcagaagagatgcacctgctcccagggctcataagccaagtaacaacaataaacaacaacagcagcaactgccggtacttatttagtgtttgtgatgttccaggctctattccaagagatctacgtgttcacccatttaatttccacaacttcacagagagggtaacactcttatcccaatgttatatgtgggacacgcacccagaattaatttgagtaacttgctgaagctctcatagctactaagtgatgcagtcaggatttgaactcatgcattctggttccagagtccatgcgcctcacaccctatgccattcagtctccattgcctactgaacatttggctctctctagattctagagctattatctgagtgaagtatgggattgatatttcattatataagtttttaaatctattcgggggaattttaaaaaatacatagtccaataagattccataaaataggtctgactactgctcagtcaactgctttaagtagttcaagacccataaaataaggggacacctgctgttcttggcaaatatattcatggtgtctccacctgtagaggcatttctttgtgcttttcaaacatggacttcagaatttaaaggtaggccactgccctggtctcttttgtctcttacatcatcaacactcagcaatgtgctggtcaaagcactcctccatcagtgcttatatttctgatttctactcccctggaaggtatctgtgctctagctggactatctctatgccatctcattataaatcttgctggttccatcttccacactgtcacctctccttctccaaaactgcttcctccacctgtaatatcaccaccttttttctatcaatccaaatcttagcctccttgtccaccaagacttgactcactgactctatttcatcaacagctttccattctttatctatggaggcgagggggaggtgcttaaggctcattttaccagttcttcagccacagtcctgagttcaatttgtttttttttttttttttttttgagacagagtctcactctgtcgcccaggctggagtgcagtgcagtggcgcgatctcggctcactgcaagctccgcctcctgggttcacgccattctcctgcctcagactcccaagtagctgggactacaggcgcctgccacacgcctggctaattttttgtatttttagtagagacagggtttcgccgtgttagccaggatggactcgatctcctgacctcgtgatccacccacctcggcctcccaaagtgttgggattacaggcgtgagccaccgcgcccagcccctgagttcaatttgaaatggatttttaggcagttccccaagacctggatctggttgaggacccaaagtcatctttttcgtctccttccaactaccacattagatcagctcgtcattctgaccttttaaaatagccaatcctttctgactttttccctttcttgctttttcctttaacatcctttgcccttcctactagggtagcctcatctctctgctgctcttcagctagtttgtttcttcccttattgttcaatctatctttgtcctgcctttgcattcattcttctttcctcttatctccccagtggctttattttttattttaattattattttttgtttttgagatagagtttcgctcttgttgcccaggctggagtgcaatggcacgatctcggctcactgcaacctctgcctcctgggttcaagcgattctcctgcctcagcctcccaagtagctgggattacaggcatgcgccaccacacccagttaattttgtatttttagtagagacggggtttctctatgttggtgaggctggtctcaagctcccaacctcgagtgatgtacctacctcggcctcccaaaattccgagattacaggcgtgagccaccccactcggcttcccagtggctttttattatacaggtatataaaggtcctataaaggtagttgtttgcatttggcgtcctgccaataaattgtactcgttaaggccagatgggttttactcatgctgtatatatttcttctcttagcaaaatctttctcatttacacatagcaaatgcttaataaatgttaaatgacttacaggattgtacagctataggaaaattagcaatcatgtaataactttcttcgtacacagagagaaaactgagatgcaaaaaaagttgccaagatggtttcagtcttagcaaattgagagtatgtgtgtatctgtgtgtatgtaaagccccagctagtaaggaagtaattgctttctctgattgtgccctttatagttttttttttttttttttttttggagacagagtcttgctctgtcgcccaggctggagtgcagtggtgcgatctcgggtcactgtaagctccacctcccgggttcacgccattctcctgcctcagcctcctgagtagcagggactataggcgtccgccaccacgcacggctaattttttgtatttttagtagagatagggtttcaccgtgttagccaggatggtctcgatctccttaccttatgatccgcccacctcggcctcccaaagtgctgggattacaggcgtgagtcaccgtgcccggccccaccctttatacttttctatgaatcctagctcccctgttagactgttaccttccagaagctaaagacccttcattgattccttttctctctctctctccccttcccttctttccttcctccttttctttttattattcgtggtgcttaaactatacgtaacaattatgaaaatgaaaatgtgaatgaataaagaggaagataagtattagagaggatattcttaaaaatctttgttagaagctacctaggccagtgtgcacacaggttactagaaaaacctgtttaaaaactaaggcaagcaggttaagttgggctcagtctgaccatgtctttcatatgcacatatgtaatgtttggtaaatgtctgttgaattgaattagattgagaaaaaagggaaactcatgtttttctttaacttttaaacctttaaaaattaactattattttagttaaagtcttacgcattttttagtacaaattaattttgatatttcctatcaatgttgttggaaataacttttattcaagtagcatgctgacatgctgtaccaaatgggtcttagcatcagtaagaactctgctttctttcacagctaatagattcccaaggctttgccttctatgcaggggacacaatttattttaagaaatattcatctcattttagtgagcccacagtgtgattggagaggcataatgagagactttctatcaatttttgaaaaaacaaaacctcaaaggacatgctggatcttaactaatccatagacagactcttccacatctctccctttgatgtagttccaaacagtgaacatcttatccaaagggctgcagtgcagagtccttgttctcccacttggttcatcccaggagtccatccatctcttgtgctctgacatcccaggcacttctcaatgaaacaaaatgaggcaaagattctctactaaatctaagcactgtttctccccctcttctaatgactttctccacaaaggctacatgggtacgctgtggatcttggtttgtagaatggaagtgattcttttctgccttcagaggaagctttcctgatttggcagaccgatgtacagaacactctgtcctgggcatctgaacctgaatttgcacttatgtcaactacattttttcattcctcaatatctatttgttttcttctccattttcagcagtatttttttcttggagatttatgagattatttatttattttgagacaagacttcattctgtcacctaggctagagtgcagtggcatgatcacagctcattgcagccttgacctccctggggtgagcttcttacctcagcctcccaagtagctgggattaaaggtggacaccaccacacccggctaatttttgtagaggtggggttttgctatgtttcccaggctggtctcaaactcctcagctcaagtgatctgcccacctcaacctccctaagtgctgagattgcaggagtgatccaccacgcctggcctaaacctttatttttgaatgctctttggtgcatgtatattaatttatatttgtaatttctatgttatatatatgtatatatgtatatatatattttcattttaagtgaggttttccagcatagaaaaaagcttacatcccagacaatatagggctctgagtgggaataaacaagttttatttctaccctagcttttactggctatgtgaccatggcaagtaacagccttcttgaacctcagtttccagtttcctcatctctctttctttctttttttttttttttttttttttttttgagacggagtcttgctctgtcgcccaggctggagtgcagtgacacgatgatcttggctcactgcaacctccacctcccgggttcaagcgattctcctgccttagcctcccaagtagctgggactacaggcatgggccccatgcctggctaatttttgtatttttagtagagatggggtttcaccatattggtcaggctggtcttgaactcctgacttcgtgatccgcctgcttcggcctcccaaagtactgggattacaggcatgagccaccacgcctggccagttttctcatctttcaaaggcaccaggcatggtggctcacacctgtaatcctagcactttgggaggatgagtcaggtggatcatttgagtccaggagttcaaaaccagcttgggcaacatggcaaaaccctgtctctacaaaaaatacaaaaatttgccaggcatggtggtgcatgcctgtggtcccagctactcaggaggctgaggtgggaggatcgcttgagcccaggaggtggagattacagtgagccaagattgtgctactgcactgtagccaggtgacagagccagacattgtctcaaaaaaaaaaaaaaaaggaacattcttacctaatgaagttgttataagtatccaacatagtataagctatgcaatagtgctttgtaggtatccagcataggtaggcaactcatatgccaaagatgatacttggctgattttctgtatcatggccagcagttgctacctcacactgaaacactgaacagattattccctgccatcatagagcttatattccaacagaaggggactggcaataaacatgtttgtatatgctaatttcagggtgtggtaagtattattaagaaaaaaaatacccaatacgatatgttccagagtgatagtgtctgtgaggtagaggtatgccacatggtgattagagaagggttttctgaggagatgacatttgagccaagacctaataagaaataagaagccagacatgcaaagaggtttataagttgggctgaggtaggagagtcttagaaagttctagaaacaaaaagaaagtcagtgttattggagtacagtaagcgagagagtagtatgagaaatggaaaggtaggctgaggtcagatcacataaggccttgcaggctgtggaaaggaccttggactggatctaaatgcagggtgtgagggtagatcgcaccaagagtctttctctattcatggtgaaatggacagacccatggcaggtacttaaaccctgggaggtttttagtactggctcttaaagccaccttcttcctccctctcatgtacatttctaaggtacttcctgggtctacaacaggacagggctttccaaaagacaactgttaaccaaaagacaactgtcaacatcatagtaacttagggaatgatgcacaaagaaacagtaaatactctctttgctgttgggagagttttccccctccaccccataactcttgatctcttgggttatttttcactctcaattgacaagacttcctgggttgcttttatcaccgtactgtcagtaacttgactgaggtcctgctctgtaacaggcatgctagctcatgtaagcattgcaaaactctgggaagtcctataggtggagagactggactcttgctgaaggtcataaaactactaaggtacacatctaagacctttttaactttcagcctgaaaaatttctttcaaagtaaaaactgcgttgtcactttgtgatgccaaagaacccttccatctatgttaccccatatcttgataaactggtaaaaaaaaaaaaaaaaagtggaatgcatgaactgtgtgcaacagtcagtcaacttggtggcatccttaaggtgccctgctcggtgaaatggcggcggtgggggatgcacatctacttctattaacactgggagttcaactgggctctctgcatcttcccaggtgctgcttcctgctgctttttacttctgctagactctgaccactctggttgtttgggtggggtatatcccatcacatggataggccatgaaaaaacctcaacccccaaggcctggtactcaaggagaaatactagacgaacattagatggtttaaagctaacagggactgaaaccagttaaaagagggaatcagacataagttgcaaactgatagaacaatgatctgctggggcacatgaggttcatgcctcccgacatgctgatgagccccggttatgagctgggcaccacaactgatggtcttttatgaaggagtgctctttacaccaaactttatctcattttggttgtccctttctagcccttgcttagttcaaaatgtagtacatctgctgtgctcatccagcttcatctactgctgagttggctgtgtccacgctcaatctgtctgctctggtttcatgatggtcactagcattcactttccctgcaaggcctactcgccggctttcctaatagtacactctcttggcacgatcctgggaacttcacgtacagttgttaccctcaaagccattgctacctgctagggtcttggttcaattggcctcatctctcactcattcttggttcctggaaacctggtacagacagatcctagtattctaaagatctcaaaatttaaaaatcattgtgacatgaatttgaagtcaaaacccaggcaatttaagtggaaataagcattcttcaggttagtcaaagtgcttagcactttgtatattaaagtgtatcctgagccacacatttgctagaaggtaagaagaaaaattggactctagaatcaattgcctttctcttttcctttgaaaagttaaaatttttaatgaaagaagttgtgtgggtacaatgtaagcttttatcatcttgcatgtgtcctctgagaggttcacatttttgaggccttgtctcatggaaactgggaaatgagcttctggaattcagacccaggatctggctgcattccagaaataaatatacatgttgggcgttgagatagacaattaaaagaataggagagtgtgcaaacttttgagaatgagaaggcagaaaatagactcttttctctcatgctttgcttttgcttttgtttattttttatatttttacttttgagtatcagctagtgagtagcagggcaaaaacaaggcagccattgatctaagtgtaaggcagcaggaggaaggttaagagaatgagtgttattctttaggactacattcatagttgcatggtgttgctcttggctcaaagtctacaattaaatcagttgttggcactcccttgaaagcattactatcacagtttcccctacatatgtaagtcaataaatttgacctttaagaaggacagttggtgtagaccccctccactgggccaacacatattgcaaatttctgaactcaggccctgcaaagtactactgccaccttgcttctttaacagagaaggcaaaataaacagaggaggattccatggtataaaaaagaaaaaaatacattatttatatttaaataaataaaattatttatagagcattatttatatgtgtcagtctgctgtgggtcaggtactatgttagattcttttatttattattttgtggaatgagatttgtttttatatatgaggaaagaggtttttcataaaagatggagccaagatttaaagctaactcatttcattcattagttatcatatttagtcaacacatcatttattgagtgcctaaaatctgacagcactgggaaacaacagaagatgaggtcactgcaccctaaaggagcatgttctcgttttttcttcttataccactgcaactgacccgtccacatttcctcaccttcatttctgtgtgcattggctggacttccagctgtcagcatctgcaattctttgcttggaagccctttgccacagtaatgacaccaagagcaaccctccatgaccaactggagttggtacgtaagcagcttagttctttcatctctcagatgggatgactctaaggtgtatgttttccactagcacctagaatttcttcagaatccaactccagttgcccacagttgtagctggcttgatcaaacatctatgtcagctgccttcccttttctacctcatgttcccacttccttgtcagctttctttacccccaggtaaactacttgcatttgaagtcttgtctcagggtctgtttctgaggaaatccaaactaagatgaccaccatttagagaatgcttactaagggatagccagaccctaaagactaatgtagatctatctgtttccaaaatctgtgatctttggagcattgcactgtactatggaattcaagcggaaggaatcccatagaatcttacacttaatcttttcttgggtactaaggaaagtggaaatccatccctagacaggatattttgtagttctctctttcggtcttcaccctctcatgggatgggtgtgttttctcttttctccacagaattgactgaaaagtctcattctgcttttatcatcacttcatttctctgaatgaatcaagcatctctgaatgaaatcaagattttctccctcccgtctgagagtaggatccactctcttgttctataggttctcttttgttctataggttaagggttaaggaaaatgtgacccccttgaacagaatagatagagaaaattattcatttggggatctctgaggagagaaattcttttctagaattttatttatattgcttcttttcttactcaacttatactacaacatagactaaaaagaaaagtggatacataactgtttttttaagtccagaatatttgacaatataatgtggtaatggtgtgaagttttacacctaagcaggcaatagaatatgacacagtttccgacctaccctgcccttgaaataacagaataactttttaacactaacatgcgtttccttgaataacttgtacctctgccaaattccacacaagaagcttcttttcttcaggggctgcttccccacaatgtgaatattctttgactcactatgttgtccatttccaatttccttgttttttgcttgagttcactgaagactgacaaacagtagcttcacgtgacagccattagtctgctttaaacctcagcttgatcttgaatggatagaataatgaatagattttgtgtcatataattcatgttgtcagttatatgaaattggcagttaaagagaaactaaatatgcttccagtcctctcttttctaaattcatatttgaatataataatgtgaaaggcattgttccttcttttagttaaagcatttttgtagcagtctgaactgtgaataatagagaaacatatgctctattaaaaaatagaaggtgaggaagataagtgttttactctttgtattaagaattaacaagtggttttaaaaattgagcttgtatgtgtgtgtgagcacagggaggggtatttcatcataatgagggaggccttggcaacttagtgttcgttttaactccattgattgccgaacacattcatgcctgctctagctccagggaggctgtggaacaggaaataagagattcaaaaagcagcacagaagaaaatcatctcctctccttccatctcccaagcagagaaaaatatgctttcttttttgtcaaaattgcttggtttgtcctattatgctgtcatttcagagagattaaaagtatactttttcatacattgcaagtgggaatgtaaaatggtgcagccactttggagaaacagatggccatttcttaaaatattaaacatagagttaccatatcacccaacagttctactctgaagtatatacccagcagaaataaaaacatatatctgtacagagactcatactcaaatgttcatagcctcattgttcacaatttttcataaatagaaaaaatccaaatgcccatcaactgaataaacaaaatgtggtatagccatataatggaatactatttggcaataagaaggaactgagttacaacatgtatgaactttgaaaatattatgctcagtgaaagacaccagacacaaaggaacatatttaactccacatatatgagatacccagaaaaggcaattctaaagggacagaaagtagatgaaagattgcctaaggctatggataggaatagagagtgactataaatgggtacaaggtttctttttgaaataatggaaatgttctgaaactaggtgttctgaaagtagatagttgccaactctgtaaatatagtaaaaatcaatgaatcataaagaaaaacactacttctattctggtaacaaaaattagaagaacaaaaaaagacagaaattatagtaaaccacaaagtaaattattacccaccatgttaaccatttagtattgatttttttttttttgagatggagtttagatcttttgcacaggctggagtgaagtggcacaatcttggctcacagcaacctctgcccctgggttcacgccattctcctgcctcagcctcctgagtagctgggattacaggcacctgccaccatgcctggctaatttttgtatttttagtaaagatggggcttcgccatgttggccagactggtcttgaactcctgacctcagatgatccacctgcctcagcctcccaaagtgctgggattacagatgtgagccactgcactcagccagtattgatttaattaactgaaatttaatatagtagaggaaaataaccaaaatgaagctctaaagcatgtcacagagtcctaattattcaaagaatcataaagatgtgatttacaccattcaataaactgcaaaaaatttgtgcagaatcaaagaaagcaggcacaacaacgtatattcttaattatttcatttatataaatttttaaaaccagtcattggtgaaagaaatcagaccaatcattgcctctgtggttggagactgactagggcacaagggatgatgtgcgctagtgcccttttgatgcatgaaagttgtaaatttctgggatgatggaaatgttctatatcttaatagtgatatgtgctatgtggatatatgcatttgtcaaaaactcattgaactgtttccttaagatctgcacattttactgcacgtaagtcatgccttaaataaaatctgataccttaaataaagtgagagacaggaagaaattggctattggaagcacaaaacaaaattgaaagtttagaaatggacccattagatatataataatttagtataggatgaaagaagaatttttaaaggtttttttagaaacagagtctcactatgttgcccaggctagagtacagaggttattcccaggcacaataatggtacactgcagcctcgaactcttgggctcaagccatcctcctgcctcagcctccgagtagctgggactataggcgtgcgccaccatgtctagcagaaattttaaatcagtgagggcaaaaagggatttttaaataacaatactgggatcaggaaagataaaagctggagtcatttcattcctaacaccaaaattaggtcagatgaataaaagattcagatagaaaaagtgaaataagtttacttcagatatttatgtattgtttggagacttttatagcaaatacattttaaactttttgtggtaaaatatacataacataaaattaaccattttagccatttttaagtatacagttcagtggcatcaagtacattcacattgtgtgcacttacttatcaccaccatccacctccagaacattttcatcttcccaaactgaaactctgtatccattaaaaaccaattctccattccttccagtccctagcccttagcccctggcaaccgccattctactttctgtcttcataaacttgattagtctaggtgcttcatataagtggaatcatacaatatttgttcttttgagactggcctattttacttagcacagtgttttcaagattcattcacattgtagcgtgtgtcagaacttcatttattttaagggtgaataatattccattgtatctgtataccatatgttgtttattcatttatccattgatggatatgtaggttgtttctgccttttagctattgtgaatagtgagctatgtacatttgagtttaagtctttgtatagatatgtttttgtttttgagacagagtttcactcttgtcatccaggctggagtgcaatggcacgatctcagctcactgcaacctccgcctcccaggttcaagcaattctcctgcctcagcctcccaagtaactgggattacaggtgcctgccaccatgccgagctaatttttgtatttttagtagagacaagttttcaccatgttggccaggctggtctcaaactcttgacctcaggtgacccacctgcctcggcctcccagagtgctaggattacaggcgtgagccaccgtgcccagcctagatatatgtttttaataagaacttgtgtgtacagatattttggtgagttccttctttcaattccatggggtctatacctagaagtggcattgaagaatcatatggtaattctaagtttaattttataaagacctaccttactgttttccacagtagctgcaccattttactttcccaccagcaatgtgcaagggttctaatttatacacatccttgcaaacgcttgatattttctatcttaatttttctctaattaattttcttcttttttttttaagagacagggtcttgctccattgtccaggctagagtggtgtcacatgaccatggttcattgtagtcttgacctcctgggctcaagtgatcctcctgcctcagcctccagagtatctgggactacagatgcatgccacaacacctggctattttttttcattttttgtagtgatggggtctcactatgttgcccaggctggtctcgaactcctggctttaagtaatcctcccaaagtgctgggatgagccactgtgcccaataaataatagcattcttaataggtatgatgtggtatctcattttgtgattttgacttgcatttccctaatatttagtgttgctgagtatcttttcttgtgcttattggccatcaatacatcttctttggtgaaatgtctgttccagccctttgttcattttttaaattggaatatttgcttttggttgttgtattgtagttttttatgtatccttgatattaaccccctatcagatgtgtgatttgcaaatattctctcccattctgtggactgcctttttactctgcggatagtgtcttttgatgcatgaaagttttaaatttggataaagcacactactttttcttttgttgtctgtgcttttgatgttagattcgagaaatcattgccaagtccaatgtcatgaaactttcctctatttttttctaagagttttctagttttagctttgacatttaggactttgatctagttttaatttttgtgttcatgtgttttctttatgagatggagttttgctcttgttgctcaggctggagtgcagtggcaccgtctcagctcactgcaacctccgcctcctgggttcaagcaattctcctgcctcagcctcctgagtggctgggattataggcgtcaaccaccacacctgactaatttttgtatttttagtagagacagggtttcaccatattggccacgctggtctcggacttctgacctcagatgatccacccgccttggcctcacaaagtgctgggattacaggtgtgagccactgcacccagcctaattttcttatatggtataaggtaagggtccaactttattatttggtatgtggatatccagttttttcaacacatatttcctactgaatgatcttggcactcttgtagaaaattatttagccatttatagccagagttgatttctggactctctctattctattgtattggtctaaatgtctgtctgtatgccgttataacactgttttgattactgtagctttgtactaagtaaattttgaaacaaggaagtgtgaaacctacacatttgtcttcttaaagtgtttttttcttagtacttggggtcctttaagattccacatgaattttaagataggtttttttatttctgcagtaaatgtcattgggattttgatggagattacattgaatctgtagattgttttggttactattgatatcttaacaatattttcttctaatccataaatgcagagtgcctttcagtttgtgtctgctttctttcagcaatgatttacagttttcatgcatgctttttgcctccttggttaagtttattactaagcattttattctttttgatgctattgtatatggaattttttttatttcttttttgaattgttcattgttagtgtatagaaatgctaatttttgtgtgttgatttcgcatcttgcaacatcactgaatttgtttattaattctaacagctttttttggtggaatctttggaggtttctacatataaaataatgtcaatggagataattttacttcttcctttccagtttggatgacttttatttctttttgttgccaattgctctgactagaactttcagttctatgttgaatacaagtggtaaaagtggatatccttgtcttattcctgatttcagaggaaaagcttttagtttttagccattgagtctgataataggtgtggaattttttatatatgatctctattatgtcacactttaaaaaaatctatgaaagtatcaaaagatggataaatatttacgtatttatacataaatataaataaacatttatatcatttgggggaaaagaatcttaataaccaaagccaaaaattataagggaaagaaaaagatgatagatttaattctgtacaaaattgaaaatatttacctagcaaaaacttcattaattaaaatgatataataaatagggataagatccttaatactgtataaaaagaactcttatatatacataaggaaaaatccacacacaaaagctacattggcaaaggacatgagcatgaaattcacaaaaaagaataaccaagggtcaaagaatatatagaaaaagagtttatcttctctagtgattacaaagaaaaatgaaattagattttttttaacctgtaagactgaaaaagatgaggaagagtgataatattcactcaatgtagtaatttcatatcctttcagtaggaataaaaattggttgagtcttttttggaaggcaccaagtattaactcttgaaaacgtgcatccccagcaactgtagttgtccctcagtatcagtgaggaattggttccatttggtaccctacaggtaccaaaacccatggatgcttaagtctcttatataaaatggtatagtatttgcatataatctacacatatccttttgtacactttactttttattttttaattttttttgagacagagtctcactctgtcagcaggctggagtacagtggtgcaatctcggctcactgcaacctctgactccctggttcaagcgattctcctgcctcagcctcctgagtagatggaattacaggcatgtgtcaccactcctggctaatttttgtatttttagtagagaacaggtttcaccatgttggccaggatggtcttgatctcctgacctcatgatccacctgcctcggcctcccaaagtgttaggattacaggcataagccactgtgcccagcccttttgtatactttacatcatctctagattactcatgatactaatacaatgcacgcacatcacttcatttgcatggattcaacatagtacttgtacacatagtacacacagcaaattcaagttttgcttttcagagatttgtggaatttttttctgaatatttttgatttgaggttggttgaatccatggatgcaggactgatgcacatgacgaacatactgtgtatacctctgggtttatgctaaggaaataattgctcaatagatatgtacaagtatgtttagctatatatctaaaagagcaaaaacttcgaaaaatctatcaactatgtctatcaactatggggccactgaaaataatgatgcagattatcgatttatagatatacatgtcatatggtttgtttcatgcgcgtccgtgtaaagagaccaccaaataggctttgggtgagcaataaagcttttaatcacctgggtgcaggcgggctgagtccgaaaagagagtcagcaaagggtggtggattatcattagttcttataggttttgggataggcggtgaagttaagagcagtgttttgcaggcaggggtggatctcacaaagtacattctcaagggtggggagaattacaaagaaccttcttaagggtggcggagattacaaagtacattgatcagttagggtggggcagaaacaaatcacaatggtggaatgtcatcagttaaggctatttttacttcttttgtggatcttcaggtacttcaggccatctgggtgtatacgtgcaaatcacaggggatgcgatggcttggcttgggctcagaggcctgacagtttggatctgtgtccccaccaagtttcatgtcaaattgtattctccactgttggaagtggagggaggtggttagatcacaggaatggatttctcatgaatggtttagcaccattaccttggtgctgttctcatgatagcgagtgagtgagctctcgtgagatctggttgtttaaaagtgtgcagcacctcctccctcactctctccttctcctgctccttccatgtaagatgcctcattccccctttgctttccaccatgattagaagcttcctgaggcctctgcagaagtaaaagctgctatgcttcctgtacagcctgcagaaccgtgagtcaactaaacctcttttctttataatttttttttttttttgagatggagtctcgctctgtctccaggctggagagcagtggcactatctcgactcactgaaacctctgcctcctgggttcaagcgattctcctgcctcagcctcccgagtagctgggattacaggcacgcaccaccacgcccagctaatttttgtagttttagtagagacggggtttcaccatgttggccaggatggcctcgatctcctgacctcaggatctgcccgccttggcctcccaaagtgctaggataacaggcgtgagccaccgagcctggcttttcttttctttttttttttttttgagagggagtctcactctgtcgcccatgctggagtgcagtggcctgatctcggctcactgcaagctccgcctcccaggttcacgccattctcctgcctcggcctcccaaagtgctgggattacaggtgcccaccaccgtgtctggccattttttgaatttttagtagagacagggtttcatgtgttagccaggatggtctcaatctcctgacctcatgatccgcctgcctgggcctccccaggtgctgggattacaggcatgagtcaccacgcctggctgcacccggcttttctttataagttactcagtctctgacatttcttcatagcagtgcaagaacggactaatacaacatggaaagatattatatattcatattcatatatttttgagtaagagaagtaggttgccaagtaacatgcctagtacaatcccagttttatttacttacatgtttaaatatttatttttgacaaaatttgggagaatatgtatataaaagtattaaaactgattgtgtctttgtagtgggattttaagtgattcatattttcctcttttgtatctttttctgaagtctctacaatgaacatgtaatcttgttagagtaatggttttgttaaatgataatattactttttcagtagcgttgagtacattgttgtgcaaccatcaccactatctggttccggaactttttcatcttcccatactgaaactctgcactcattaaacagtaattcccctttgcccctcctctagtgataatagctttaaatcaagaaaattctacatttaataattttattttttcccccttcccaactacacatatacttttaagaaaagaacagttttattgagatataaatcaaatgccatacaattatcctgtcacacacatactttggaagttctgtgaccctctttgtagtttgtttgtttgtttgatggaagcatttttaccaggcagaaagtacaacgttggaagtgaatgttcttgaatttattggagacaaattatagaggaataatgatatgtgaattttacctaccataaacctgcatcctgtatttggacaggagctctgtgtaccttcaaaaactgttcaaaactggttttaggtccagctccctgtgaaagttgagttaagctaaagagcaggaatctattaacaggtcaacagcagcaggggggcggggattggaaagggcctggagcagctgcggttcatttgggagtttaaaattggcttttcttttattctcttattcctgctacctccatagaatccaggaagaatagggatgttttttcctacatttgattataacaggcccaaatctctttgaacataaccagtaaaggaaagaagcatccgtggccatcaaactgggtaaaatggtaacataatctctgatgtgtagtttgaatcctattaattataattgtgtagaattgtacagtgagaatgctttgggagtttttaacgctaggtttttcaaagactacattcctcattagaccttccccattaaggcatgcttgagtgatgctacacagccgaatagttgggattttttccccctcttgtcatagtctgaagacaaaggattcttccgcttgccaaagttccagggagcctaggttgagccgctgtgacagcacttcggcagggagctttttattcagtcttcgatttgccgtcaggcctcattcacgaaacaggatcaagttggagcagtacacggagaaaaaaaaatcaacagaggaaaatctcgcacagccagatatggcgccatgggtcactttttcctttcactaatgctgagtcatgatgcagtctaggctaaggcacagaaaactgtacatttctggtcctaactgcattgttgtccctcaggattctcggtgcctttgctaaagtaatgttacaacagtccagaaaatgctagcattagtattgcagcttacttgacttctctgagaagcagcgagagtggcacaaaagagctgggagccctgcagttgataccaaaataacctgccaatggccttacaaccttgctacttctcagtttttcctagcctcagtttcctcgtctacaaagtatggataatgtgctgctgcttcttatttacaaggttcttgtgaggatcaaacagaggtaatgcatatgaaaatgtttgttacattacccaggaatgattcttattatcatcagaatttttatatttgaatttagaagttgtatgtatgtgatcgcttctggattatgtgtgtgtgaacttcacacattatcaaaagagattacttttttaatattgtttgcccaagggaaagtgttgagggctacataagtttaaaaatgactttaacttaggcattagatataaaatggtctccccatttgccttcaattcagtaaaaacagcatatttgtgattggctacatcaacaggcatccttccctcttatgtataatctggtatagcatagtgattaaaagcacaagctgtagagccagatgcacaaacacaacatttttgtgttgacaaaagacaaagacactaccaccgttgcgacctttatgtatcttactatctaaggtttttaaatccatattacatctttacaccatcggttgtttattagtttattagagctggcaaaacaaaatgccgcagactgggtagcttaaacaacagaatatttttttcacagttctggaggctagaagtccaggatcaaggtgtgagcaggtttggtttctcctgaggactttgtcctaagtttgcagaggctgccttcttactgtatcctagcaggtctttcctctgtgcccccacatctctggtgtctctctgtatatccaaatttcctcttagaagaggccactagtggtagctcacacctgtaatcccagcaccttgggaggctgaggctggtggatagttttaagtccaggagtcaagaccagcctgggtaacacagtgaaagcccgtatctacaaaaaaaaaaaaaaaaattagccaggcatggtagtatgcccctgtagtcccagttacttgagagctgaggtaggagaatcacctgattctgggaagtcaaggcagtagtgagccataatcacaccaccactgcactccagcctgggtgttggagtgagaccctgtttcgaaaaaatacaaataaaaaaaatttaaaaaaaaaaagaagaaaaagcaattagattgtattagggcacatcataatggctttattttaacttaatcacctctttaaaagccctatctctaaaaagtcacatctgagacactgggatttagggcttcaacataggaattttgggagaacatagttcaacccctaacataatgctctctactccacagataatgcaaaattagccaagggaccaggattgactctagtatcatacaaaagagtcaaaggcaattgtgagtctagtagtaaaatttatttgaatatctcatgtggtactcacatcaatcatataaaagacatctgacttttatggagaaactcagactttcatggaaaatcatagatatttggcaataatttttggcttagtccataaagagtttggaaattagaatttggggttgtgtcagaatacggaaacagaattcacactagttgtttcagcagaggaaatttaatacagagaataagtataaagatatttactactacctgcttaccagatgcaattttgcatgatattctaaatgaagcagacacatgatagtttgtggcatgtcaagatgatcaagaatatgacagtgcaggagttgacatagttctgagacagcagtgtgaaggtatgctgttgtcctcattaggtgaaagcaaaaggcttatggtaattcttgagaattttttgaaggggaaaaaaatgttaagatcaatagctaagtactacatgcgagatacttgtattgctttgctcaagttatcacatctggaacagcagttgcaattggcattacttgattaagtttacaaaaatccatattcactgtccaagatgaataaatctgcacaggccaaattaaatgggaatgttaggaatcacacctgtatcttttaagtctttggtggtggcattaatcttgacagttcttccaagggtgtgataattgcttttagtttaccattaggataggacaaaaggagttccaagggcttccacttggccctcctacagtattagctctttctctacatcccagtgtggaaattagatcatttttaaagcatgttggctgggcacagtggctcacacctgtaatctcagcaccttgggaggcgaagatgggcagatcacttgaggtcagaagttcaagaccagcctggccaacatggtgaaaccctgtctctactaaacatacaaaaatgcacacctgtagtcccagctacttgggaggctgaggtaggagaatcgcttgaacccaggaggcagaggttggagtgagctgagatcatgctgctgcactctagcctgggtgacagagtgagactcagtctcaaaaaaaaaagcatgtctacatatagtctacatatatgatacattaaaactatagaaataactatagggtagatcctataagatagacgagcccaaacttcatttaccacttgatatggtttggatttgtgtccccacccaaatctcatgttgaagtgtaatccccaatattgggggagggactggttatgggtgactggattatgggggtggattttccccttgctgttctcatgatagtgagtgagtgctcatgagatctggttgtttgaaagtgtagcacttccttctttgttctctctctccctctccctctccctctctctctccctctccctctccctctccctctccctttccctctccatctccatctccctctccctctccctctctccctctcctgctctgccatggtaagacatgcttgcttcccttttgccttccaccatgattttaaatttcctgaggccgcccagccatgcttcccatgtagcctgtggaactgtggatcaatttaacctcttcttttcataaactacccagactcaggtagttctttatagcagtgcgagaatggactaatatggaaaattggtagagaaggggggcattgctataaagatgcctgaaagtgtggcatcgtctttggaacttggtaatgggcataggatggaacagtttttagggctcaaaagatagtaagatgagagaaagtttggaacttcctagagacttagtgaatggttttgaccaaaatgctgatagtgatatgtgatatggacaatgaagtccaggctgaggaggtctcagatggaaatgagcaacttattgggaactgaagtaaaggtcactcttgtgatgctttagcaaagaggctggtggcattgtgcccctgctctagagatctgtggaactcttaacttgagagaaatgatttagggtatctggtgaagaaatttctaagcagcaaagcattcaggaagtggcctggctgcttctaacagcttaggctcatatgtgttcacagagatggtctgaaattagaacttatatttaaaatggaaacagagcataaaagattggaaaatttgcaacctgatcatgtggtagaaaagaaaaacccattttctgggaaggaattcaagccagctatggaaatttgcataagtaaggaggagcccaatgttaatagccaagacaatggggaaaatgtctccaagacatttgagagacctttgtatcagcccttcttatcacaggcctagagtcctagaaggagaaaatggtttcatgggccaggtccaaagccccactgctctttgaagccttgggacctggcaccttgcactgtggctgctccagctccagccaaggctaaatggggtcagggtacagctcaggccattatttcagagactgcaagtcccaaaccttggcagtttctacatggtgtttggcctgtgggtgcacagagggcaagtgttaatgcttgaaagcttctacctagagttcagagtgtgtatggaaattcctggatgtccaggtagacgtctgctgcaggggcggagcccttatggagaatctctactagggcagtgcagaagggaaatgcggcatcagagtccccacacagagtcctcacttgtgcactgcccagcagagctgtgagaagaaagtcactgtcctccatacctcagaatggtagatccactaacagcctgcactgtgcacccggaaatgccacagtcactcaacaccagcctgtgaaagcagctgtgggggccataacctgcagagccacaggggtggagccacctaaggccttgagagttcacctcttgcatcagcatgacttggatgtgatacatggagtcaaaggagattattttggggctttaagatttaatgactgccctgctgggtttcgcacttgcatgggacctgtagcttctttgttttggccaatttctccaatttggaaagggagcatttacccaatgcctgtaccccattgtatcttggaagtaactaattttttttttttaattttataggctcataggcagaagggacttcctagtctcagatgagactttggacttggacttttgagttaatgctggaatgagttaaaactcggggggactgttgggaaggcataattatgttttagtgtgagaaggacatgagattttggagggggcagggtggaatgatattgtttggatttgtgtccccacccaaatctcatgtcctattgtaatccccaatgttgggggatgaacctgatgggaggtgattggatcatgggggtggatttctcccttgctattctcatgatagtgagtgaattctcatgagatctggttgtttgaaagtgtgtagcacttccctctttaccttctctctctctcctgcaccaccatggtaagatgtgcttgcttccccttcaccttttgccatgattgtaagtttcctaaggccttccagctgtgcttcctgtagagcctgcaggactgtaagtcaattaaacctcttcataaattacccaatctcaggtagttctttatagcagtgtgaaaatggactaatacatcacctgaacaccataaatgttctctttggctactgatccccagtggtgttttgagtgcctgaactagcattcattcacaaccattatatagaattcttcaaggatatatagaatctttaatttctctcaataaaaaggtcaaacttcacttgaatcatattagcaagtttaatccacattatttgtttatctggagagctagcatatgtctacatatgtatgtatgcatacctatttattccaaaactgatttaaagtgtgcacttatctaagaagttgtagtagccaaggtggtacactgctcagatgttacttcaggagaaactgcttcaaggaacataattgtcagacagtttccagctgttacacctttggatctgctgcagtgtttatgccaaggccatgctcaccccaggctgctactagccaatagctgaacatattggggtatgaaagccatgccattctgcctgatgcctcttacagtaggcaatctttgctccaggacttcccatcagcctggccaagactttctcagaatcacactgcaggccgaagctccttttcctcagtcctcctgccttccctcctggctttctctctcccctttcacaggtgtcagatccacattgtgttcaaagagctctcttctcctatttctgatacctcacttgtttatcctctgtaggtgtttctcctaatacatctcttgcacatctggttccaccttggcatctgtatctttgaggacctaaacagacacagaaatcaagtaacaatgcaaaaagcctgacgctcactgactattagattgttgacaaatataagattgctgggccttgggaaagcataatttcacttgttcctaataactgaaaatgctttttgaaaaactaaatatgccatgcataaagggcctaagatttaggttttcctgtagaaaaacatctgtgccctagtgggaaagtatcacttttaaatataaaattttaaaatgaatccagggaagacattaaattcccaggattgaggacaataaccaagaacctgaacagcatttacgtgtttgttggtctctgctttctttatcttgccctctttgcttcctgctttatgttataaagtgttaatgtgtcaaaaatgaaaaatgtagggttggtgtgatgttctcaacaggcttcttgaaaaatatttttttcatctttcaagaatcagctaaaattgaatttggcattgtttgccctttgttgcctaggcattggggtcagactcttgtctgacctaagtgaagccatgatggacagttctgtagagggcattatcacagcctaatcagataaactgaaagcaaaattgtttttctctctcccacagaatctgctcctccattttcttcctcttttatattcttttctaacttgccctgtgaattttcaagacatagtaagattttattgttattactgagatagattggttgcagaaactgttgtatgaaccaaatgtcttctgccttgtagatagacttcctcaggaactaagagcagtgtctgtacgcctcaggtaacaagtcactgccaactctgtaatacgttttaacctgatgcagaagtaggggccctgctgttttctggattctttagccttttgttcaatgtaataatgcatttaatcatgggagaatttaaaacatttaccttgtaatagtagcaataagtctaagtcccaaatcaatagaaacctggcaaaaaatactcagactaaacaaaattaccaagaacaacgacaaaaaccaaatcctaagagccataaaggaatcccttttttgtacatgtttaattttacattttagcaaaaataaaaaataaggaagcaataagtttaggtttgggctgaagatgcaatgaaaatataggcttatgagaaagtaaaatactaataaaatagtattttgcttctctgctgggggagtaagtgaaggaaactaatatttcttgcatttatgctatgtgccaacccttgtgctggatgctttttatatatattatcttggccctccccagaacccagaaaagttttttttttttttctagacagggtctcactctgtcacccaggccggagtgtggtgactcaatcacgactcactgcagcctcaaccctctgggctcaagtgatcctcccacctcagcctcccgagtagctgggatttcaggtacatgttatcagacccagctaatttttttaaaaatttttggtagagatggggtttcaccatgttgcccaggctgctcttgaactcctgggctcaagccatctgcctgcctctgcttcctaaagtgctgagattacaggcacgagccaccatagccagctcccatgtcatcattttgtcagtgagtaaactgaggcttagataagtgaaataagctgcctgaaatcgcatgcgtttgtggtccctctgggattcaaacccagtcctgtctgactttaagttgtggataaagaatgattttggaactgtgaaggctaagcaaatactggtgagagggactaactcacacatgagacagctaaataatgaagtacatacagtctagagcaagcaaagacccaggctagtggtaatcactccctatgtattttgccagtcctaaccagagtctgagagccccttacaagtgaagtcactgcaactgcaattggtgatctttcaggaactaagtgaggaaaaggaggaagcatggaaagacttgagatgaagataagtagtcccaactttcacaaacccgggtataacttcaataatttctgttgcctttgagacatgttgagccctcagttgcctgggcttgagggaagttagtaccagaactcagagaaaggacttggttataaggctgattccaaggagtgcataaaactttctaatatctgatactggaaatgggaatgaagagttcagtcttgatttaaactagctccattattctaggaggtgggacataaggaaatatagacagcagatgacatttgaattaacataaggggcatagaatggcaagcagcctgttgggagccagaccagttaagagttaaaagacaagattcagcccactgggaaagtgtgctgttaactacaagtcagagtaataggacttcatcagaagggctggaactaatttttgcctatcctcttgaccaagatttgacaagagtgacggaagaggaaacattctacatataggggacattcctacatattgctagtagaaatgtaaattaatacagtacctacagagagagtatcttggcagtatctgttggaattacaaattcacattttctttaacccaacaagaccacttttaggttttgaacttgtagaaatactcaatgtacacagtcatgtatatacaaagacatttctgcaggattcttgaaaagggcaaacaaattatagaattccttgtctcttgactaggatttttgtataggttttataattccctcttagggctttcagtagttaccacttagctattatttttataataaatgagtttatttttaaattattatgttaattcataattattatgataattaaagccaaaattgtattatatataaatatatatacatatatctaaatatttacacattagtttaagcaagattatgttgttaaagctattttcagtttaatgtgatacagtgttttgtttgttaatagtgattcagttaaggcagatagccatatcaaaagcatttgatggcctggcgcggtagctcacacctgtaattccagcactttgggaggccaaggcaggtggatcaccagaggtcaggagtttgataccagcctggccaacacggtgaaaccccatctctactaaaaatacaaaaaaaaattagccaggcgtggtggcaggcgactgtagtcccagctactcgggaggctgaaacaggagaatggcatgaacctgggaggtgcagcttgcagtgagctgagatggtgccactgcactccagcctgggtgacagagcgagattccatctccaaaaaaaaaaaaaaaaaattagccggacatggtggtgtacacttgtaattccagctactcgggaggccgaggcaggagaattacttgaacctgggaggcggaattgcagtgaaccaagatcacaccactgcactccagcctaggccacagagtgagactccatctcaaaaaaaaaagagcatttaataagcatttcaatttttaaaattaaggaaattttggttttgactataggtcctagtcaagtctttccagaactgatatggccaacctctgttgagcaatgtggatgttagaagatggggagccagtgagggactgcaggttaagggatgtgtagtaagctgttaggagcaaggccacctaagtccccccacttaaattcccagtcgtttcatttcctgttttttctttttgtccccaattgtctttttttttttgagacagagtctcactgtgttgtgcaggctggagtacagtggcgcaatctcagctcactgcaacctctgcctcccaggttcaagcaattctcctgcctcagcctcctgagtagctgggacgtcaggtgcatgctgccacacccagctaattttttgtattttagtagagaccgggtttcaccgggttgcccaggctggtcacaaactcctgagctcaggcagtcgacctgccttggcctcccaaagtgctgggattacaggcgtgagccaccaggcccagctcccagtgtcttaatgtagtactctaggtggatgagaggattggggtcaggaaaaaagtctggtaagtcaaagaatagagctgggtttgatttgaaaagacaagataatggacagtttttaagagatagagctttataggaaggaagattgagatttaagacgaaatatgtcaagaatgggtcagttaagttctacctggtatatcagatctccttctttaaagcttcactcttcattgacatacacagacagatttaaacaatttaaacaaaaattatagctaactcttaagtacttaatatatgcccaagcttaatgctttatatgcattaactcactgatttcttacacctctatgaagtaggtcctattataatccccatttaacataaagttgaggaaagaggcctatacactaagtgatttgaccccagacccatagctattcactatactgtgtctctctgtctacctcatagggtttctgtgagaatcaagtgagttttgtgtgtgaaagtactttgaaaaccacaaagcatttgatacttgaaaaccagttctcaagagatagaaaatgttattcactctactctgtggaacaattctttaaaaacaggacttggaaagcaagctactgtcaaaactaaaataaaattaacctcaaattagaggagcacttttagatgacaaaataagtactaagaaaatacaacaataaaaagaaaaaatgacatacaatcaagatacaagactaattgtaatttttaaaatggccttttttgatggggtgagagtttttcacagagctgaaagctgtgattgcattgccacattttacaaaacagtctctggaacaggattgacctggctatcaaaggataattacatggcctaatagattgtccctaccttcaactgctaatgaagcccttggaaaatgtatcccccacttaacgaatgaggctgaaaatgccaagaagccttttgccaaggatgtgttctctaggctcaggctgaattcattattttgttagagtattaccaccaagccaaccatgggcaatttagcatgccacatttcaagcagaatttaattcatctctgtgtgccataaatgagacaaataccctgtgatcaggtgacagctgtcagtaatgccataaacagaaagtattaatgtaagtggtgaattcctcttaatcatacccccattaaaagctggtacaaaaattagggggtgtgtgtgtgtgagagagagagattgtgaggaaaggcatgcataaaatagtctgattactttacgatactcaactccacttttgttataaaacctcacttattttcataccaaaaaacaacaggtaaatttcttgatgaaagaaagtacctctgagttaccctttgtctgaaaatgtatgtctttttatggaattgcctagctctgaagatagctattgcttataaagactagtttgttcttcctttctttctttttttttttttttgagatggagtctcactctgtcgcccaggctggagtgcagtggcgtgatcttggctcactacaacctttgcctcccgacttcaagtgattctcctgcctcagcctcctgagtagctgggactacaggtgcacaccaccacgcctggctaattttttgatttttagtagagatgggttttcaccatgttagccaggatggtctcgatctcctgaccttgtgatccacccaccttggcctcccaaagtgctgggattacaggcatgagccaccgcgcccagccagtttgttctttctttaagaccacatgctttccttaatgtagcaaatctaaaagcagggacatttggaatgttactcaaagtgggagggagtcctaccacccagggagcctgacatcccagtcagaaagtgacatatgaatgtattaagaatgggcccaacatctaacaataaaaaaaatgggttaccttaaacaccattttttgaacacttactgctcccaggctctgaacatctgaagaaacatctgagagacaccaaggatgcagtgagaatcttttttctcattagatgtaagagcagctctcagttcttttgggcatcagagttacctaggaagagttgggggttgtattttgcagtctctggagtcagactacctggttttacatcctgtctctgctgtttgttagttgtatgatcaagggtgttacttaccctcagtaagtctagtgcttctgtttgtaaaaatgaaagggggaatagataaaaatagatctatcttattaagtaaagatggactgatataatgcctggtgcagtttcaggcatatggtgagcatgcaataaataaatactagctcatttattattagtagtagaattatgtttcttctcctacccagagtgagacattaattgatcaaaatgtgtcatacacctcatgtggattggggcaaaacaaaaaccaaaagagaaacacagttttgtgcaataatttaaatctcttaaataaaaaatgtagagaagttgctgttagtaaaatgtactgacttttcattctttattaattcaatgatatttgttatcaaatattataataaatgctgtttgagcccaagtataaatctgatttgtgacttgccttcaagaaccacagtcttgtcatggagaggagaggatgttatgattgggaagcagtggtggggcactagaaggggtgggtcttctggagatctgacaaaattccatttcttgacctgggtggcagttctataataataaagttatgcatctatattatatgtactttttggtgtatatgttatagtcacagtaaaaatgtctttaattgtggtatgtgagtgatttgtatctcagtttaaaaaaattatatgggatattcctgaataaaccttggggaatgtttctttctttcttttttttttttgtgataagagtctccctctgtcgcccacgctggagtgcagtggcgtgatctcagctcactgcaacctccgtgtcctgggttcaagcgattattctgcctcagcctcccaagtagctgggactacagacatgtgccgccatgtccagctaatttttgtatttttagtagagacggagtttcaccatattggccagactggtctcaaactcctgaccttgtgatccgcccaccgcggcttcccaaagtgttgggattacaggtgtgagccaccacggccggccaggaatgtttcttagacaaagcatcaaaagcacaagcaaccagcatatgttaattagcttgatttagccattctgcaatgtatacatattgaaagcaacaagttgtacaatatatacgatttttatttatcagtaagaaaaaaagcacaagcaatcaaagttaaaatagacaaattggactttattaaaattaaagacttgtgcttcaaaggatactattgagaaagtaaaaatataacctatagaatgcaagaaaatatttgtaaattttctatctgataagagtctggtatctagactatatgaagaattattatgactcaacaatgacaaggctgggtgtggtggctcatgcctttaatcccagtgctttgggagactgagatggaaagattgcttgaggccaggagtttgagaccagcctgggcaacatagtgagaccccatctctatgaaaaattttaaaaattagctggacatggtggcatgtacctgtagtcctaactactctggaagctgaggtgagaggattgcttaagcccagcagtttaaagttgcagtgagctatgattatgccactgcactccagcctgggcaacagagcaagactctgtctcaaaaaaagaaaaaaaagaagacaaccccattttaaaatgggcaagaggtttgaacagatatttttccaaaaaagatatataaatggtcaataagcacatgaaaagatgctcaatatcattaatcaccagggaaatgcaaatcaaaaatacaatgaagtatcactttataccctctaggatggctgtactcaaaaggacagacaataaaaagtgttggccaggatgtgaagaaattaaaactctcacacattgctggtgtgaatgtaaaatggtatagttgctttggaaaacgactggctatttcctcaaaaagttaaacatagaattaccatgtgtcctagcaattccatttctatccaggaaaaattaaaacataagtccacacaaaaaacttgtacatgaatgtttatagcaataacaaaaaagtagaaaaaaaattttcatcaactgatggaaaaataaaatatggtgtactcattgatgaaatattattcagtcatataaaagaatgaagtactgattcatgctacagcacagaggaacattaaaacgttatgctatgtgaaagaagccataaaggccacacattgtataattccatttataagaaatgttcagaataagcaaatccataaacacagagagagtattagtggttgtcagggactatgggggaggatggatgggagagtgactactagagggtacaggacttaattttagtgtaataaaaaatgttatgaaattagatagtggtaagattgtaagactgaatatgttaaaaaccactgacttgtgtactctaaaaagctgaatattctggtaagtgaattattatctcaataaaataaataaaatacaaagtatgggatagttccatgctttgtaatggttatatttgactaaattatagattgtacaaagagagtaatgggaaataaattttaaaatataaattgaaatcaaattataaaaggctttattagtgagaagctgtcagtagagaaccattaaagatttctgaggccaggcatggtggctcacacctgtaatcccagcactttgggaggctgaggcaggtggatcaactgaggttgggagtttaagaccagtctggtcaacatggtaaaacccatctctactaaaaatacaaaaaacaacaacaacaaaaagccagacgtggtgatacatgcctgtaatcccagctacttgagaggctgaggcaggagaattgcttgaacctgggaggtggaggttgcagtgagctgagatcgcgccactgcactcctgcctgggtgacagagtgagactctggctcaaaaaaaaaaaaattttttttttgagaaagtgaggaatgtgattagagcgtggttcaagaaatttagtctagcatcattttgattcatctctgcgtctttcctagcctttgtactagagaggacagtgattatgtactttgtagcttagttttgtcttagggaatacatatgattttagaaatttttcaaaggactggatcatattagcctggtaaattgaattatatgtcgttttgtaataatacaatgtatatgaatatatacaagcattacctcatttcataggaaagaggtgatagataaaatgagaaaaagcgagattttggttgtgtttactaatacatatttctgatttggagaactgggaagggaaaacataactgtattagtctaagtctcaatgggttgctatattagaataattcactaagggttgtcaaggactgtgaaggatctgagaattgaccttaccagcaagctaacaaattaacctgccatagtttcatgaatgctggcagaagacacaagacttttgggtcagagataaaggacttttgcattttatcatagttgatttcaactttagttagtggaagagttaactagttacacaatttttagaaatgtaatcaaattagtacttgaaagctccaatatatttattgtaaaataaaatattcaatgcagaagttgcataaaacctgtttctcacattgctttttgaatacatgcttaagggacatttaagagtctatggcaaatgttggctctttggattgaaaaccacaagctaaaaaagaatattaaggaaatccaaagcaaatcacttgatttataccaagcactcaattttctcaacacagttcttcagaagacagtttcagtaaattgtgttaaccacagattcattgtttacaatagctttcattaatgtaacattccacagtagggaaaaaaattttacaatgagtgagaaaacactctgtaattaattctcctagtgttttctacaatattccaagagatctgtgtggatcacaaaacaatactgttttttaaaaaaattctgttctagaaatcacatgaaacaatcctacctgtaactgcaattgtattttattttatttaaatctgatgaactgcatgggcatacaacacaatgtgagggcaattgtgccagcagaatatgtctatgatcaggcagtatgctgagaaccagcaggtgggggaaaatgagacttgggggactacagggaatgaatctggaggcagcagcaattttttagaataatttgaaaaccctttgttttgaaggatttggttacctaattaggttagagaagcttgtgtgctttgtacacaaggagagatgatctctatgcttttcctagactctcaaagccatttgtgttaattatatgacctccactaagcactcaaggtctggcctatgatatgttttctgtactcttccaaatgctcatacattcattattaagaaacttggcttcagagcatcagattactgcatttcttgtaaaccagcttagtggcaacaaaatccaattcatctctagacattgggttttcttagatgagctcttctatttttctgtcccttggttaaagaagagctgcaaataggtctgcagagctacttggttatcagttttacttactatcaaaagatctgactgtataacctttgttcttagatatttgctgtgtgtaatttattttattttttggttactaaaacattttcctttttcttaagcagaaatagcacatgactaagaattagaatatgcagtctctcctttcatctcttaatccctcacatataacctgatgcattaagataatgcttttgggaatgtgctatgggtttcaacaacatgtgtgactgctaatgagctgggataggcttggctatgatttctctaaggctggagttcctacgagtgtggagaaatacatattaaaggattaaagatataagagaatgttcatgaactatatcttaactagttcttgtttttaatttatttattttttgagacagagtctcactctgttgcccaggctggagtgcagcggcctcatctcggctcactgcaagctctgcctcctgggttcacgccattctcctgcctcagcctcccaagtagctgggactacaggtgcccaccaccacgcccggctaatttttaatatttttagtagagatggggtttcaccgtgttagccaggatggtctcgatcttctgacctcgtgatccaccccccactcggcctcccaaagtgctaggattatgggcgtgagccaccacacccggcctatcttaactagttcttatggctgaaataagacagagagactgggaacatttcctaaccaaaataggatttggttaaactttgtatgcggtaagaggaaaggacagaccctcttagaaaactcagaccattgccccttgcctcaagactgcacataacataatcctctttctgtttttgcctgaattgcccagatgctcaaagccattcataatgttcacagtgactatattaatttttaaattttggaattattctcatgattttttatcatatatacatatatattgtttgtataggtggtatatgtgtgtgcatatatatagaaaatatatacatttacctataattgcttttggaaacaagtgagatatcaagaacatgttaaagaacagatgatgtgattttgtggctggcaagatggccgaataggaacagctctggtctgcagctcccagtgagatcaacgcagaaggcaggtcatttctgcatttccagctgaggtacccagctcatctcattgggactggttagacagtgggtgcagcccatggagggtgagcagaagcagggtggggcatcgcctcacctgggaagtgcaaggggttggggaactccctcccctagccaagggaagtcatgagggactgtgctgtgaggaatggtgcattctggcccagacattatgcttttcccatggtctttgcaacccacagaccaggagactctcttgggtgcctacaccaccagggccctgggtttcaagcacaaaactgggcggttgtttgggcagacaccgagctagctacaggagtttatttttcataccccagtggtgcctagaatgccagcaagacagaattgttcactcccctggaaagggggctgaagccagggagccaagtagtctagttcagcagatcccacccccatggagcccagcaagctaagatccactggcttgaaattctcgctgctagcatagcagtctgagctccacctgggacactcaagtttggtggggggaggggcatccgccattaccaaggcttgagtaggcagttttcccctcacagtgtaaacaaagccactgggaagttcaaactgggcagagcccactgcagcttcacaaaaccactgtagccagactgcctctctagattctgcctctctaggcaggacatttctgaaagaaaggcagaagccccaggcaggggttgataaataaaactcccatctccctgggacagagcacctgggggaaggggcagctatgggtgcagcttcagcaagcttaaacattcctgcttgccagctctgaagagagcagcagatctcccagcacggtgctcgagctatgctaagggacagactgcctcctcaagtgggttcatgacccccttgcctcctgactgggagacacctcccagtaggggatgacagacacctcatataggagagctccggctggcatctgacaggtgcccctctgggatgaagcttccagaggaaggaacaggcagcaatatttgctgttctgcagactctgctggtgatacccaggcaaacagggtcttgagtggaccttcagcaaactctagcagacctgcagcagaggggccggactgttagaaggaaaactaataaacagaaaggagtaacatcaacatcaacaaaaaggatgtccactcagaaaccccatctgaaggtcaccaacatcaaagaccaaaggtagataaatccacgaagatgagaaaaaaacagctcgaaaaggctgaaaattccaaaaaccagaacgcctcttcttctccaaaggatcacaactcctcgccaacaagggaacaaaactggatggagaatgagtttgacaaattgacagaagtagggtacagaaggtatgtaataaactcctctgagctaaaggagcatgtcctaacccaatgcaaggaggctaagaaccttgaaaaaaggttagaggaattgctaactagaacacccagtttagagaagaacataaatgacctgatggagctgaaaaacacagcacaagaatgttgtgaagcatatacacaagtatcaatagctgaatccatcaagcagaagaaaggatatcagagactgaagatcagcttaatgaaataaagcatgaagacaagattagagaaaaaagaatgaaaaggaatgaacaaaacctccaaaaaataggggactatgtggaaagaccaaacctacatttgattggtgtacctgaaagtgacgaggagatggaatcaagttggaaaacactcttcaggatattatccaggagaacttccccaacctagcaagacaggccaacattcaaattcaggaaatacagagaataccataaagatactcctcaagaagaacaaccccaagacacataatcatcagattcaccaaggttgaaatgaaggaaaatacgttaagggcagccagaaagaaaggtcgggttacccacaaaggagagcccatcaggctaacagtggatctctctgcagagaccctacaagccagaagagagtgggagccaatattcaacattcttaaaagaattttcaacccagaatttcatatccagccaaactaagcttcacaagctaaggagaaataaaatcctttacagacgagcaactgctgagagattttgtcaccaccaggcctaccttacaagagcttctgaaggaagcactaaatatggaaaggaaaacccagtaccagccactgcaaaaacataccaaattgtaaaggccgttgacactatgaagaaactgcatcaactaacaggcaaaataaccagatagcatcatactgacaggatcaaattcacacataacaatattaaccttaaatgtaaatgggctaaatgccccttaatagaccgattaaaagacacagactggcaaattggataaagagtcaagacccatcggtgtgctgtattcaggagacccatctcatgtgcaaagacacacataagctcaaaataaagagatggaggaagatttaccaagcaaatggaaagcaaaaaaggaaaagcaggggttgcaatcctagtctctgataaaacagacttcaaaccaacaaagatcaaaaaagacaaaggcattacataatggtaaagggatcaatgcaacaagaagagctaactatcctaaatacatatgcacccaatacaggagcacccagattcataaagcaagttcttagagacctacgaagagacttagactcacacacaataatagtgggagactttaacaccccactgtcaatattagatcagtgagacagaaaattaacaaggatattcaggacttgaactcagctctggagcaagctgacctaatagacatctacagaactctccatcccaaatcaacagaatatacattcttctcgcaccacatcacacttactctaaaattacctacataattggaagtaaaacactcctcagcaaatgcaaaagaacggaaatcataacaaacaatctctcagaccatagtgcaatcaaactagaactcaggattaagaaactcactcaaaaccgaacagctacatggaaactgaacaacctgctcctgaatgactactgggtaaatacgaaattaaggtagaaataatgaagttctttgaaaccaatgagaacaaagatacaatgtaccagaatctctgggacacagctaaagccgtgtttagagggaaatttatagcactaaatgcccacaaaagaaagcaggaaagatttaagatagacaccctaacatcacaattaaaggaactagagaagcaagagcaaacaaattcaaaagctagcagaagacaagaaataactaagatcatagcagaactgaaggagatagagatacgaaaaacccttcaaaaaatcaattaatccagaagctggttttttgaaaacattaacaaaatagactgctagccagactaataaagaagaaaagagggaagcatcaaatagatacaataaaaaatgataaaggggatatcaccagtgatcccacagaaatgcaaactaccatcagaaaatactataaacacctctacacaaataaactagaaaatctaaaagaaatggataaattcctggacacatacaccctcccaagactaaaccaggaagaagttgaatcccttaatagaccagtaacaagttctgaaattgaggcaataattaatagcctgccaaccaggtaggctattaaaaaaaaaaaagcccaggaccagattcacagccgaattctaccagaggtacaaagaggagctgtaccattccttctgaaactattccaaacaatagaaaaagagggactcccccctaactcatgtttaactcattttactcctcccagcatcatcctgataccaaagtctggcagagacacaacaaaaaatgaaaatttcaggccaatatccctgatggacattgatgcaaaatccttaataaaatactgacaaaccccaaatccagtggcacatcaaaaagcttatccaccacaatcaagtcagcttcatccctgggatgcaaggctggttcaacatgcacaaatcaataaacgtagtccatcacggaaacagaaccaatgacaaaaaccacatgattatttcaatagatacagaaaatgccttcaataaaattcaacaccccttcatgctaaaaactctcaataaactaggtattgatggaacatagctcaaaatattaaaagatatttatgacagacccacagccaatatcatactgaatgggcaaaagctggaagcattccctttgaaaactggcataagacaaggatacccactctcaccactcctattcaacatagtattggaagctctggccagggcaatcaggcaagagaaagaaataaagggtattcaaataagaagagaggaagtcaaattgtctccgtttgcagatgacatgattgtatatttagaaaaccccatcatctcagcccaaaatttccttaagctgataagcaacttcagcaaagtcccaagatacaaaatcaatgcggaaaaatcacaagcattcctatataccaataatagacaaacagagagccaaatcatgagccaaatcccattcacaattgctacaaatagaataaaatacctaggaatccaacttacaagggatgtgaaggacctcttcaaggagaactacaaaccactgctcaaggaaataagagaggacaaatggaaaaacattccatgttcatggataggaagaatgaatatcgtgaaaatggccatactgcccaaagtaatttatagatccaatgctatccccatcaatctaccattgactttattcacagaactagaaaaaattactttaaatttcatatggaaccgaaaaagagcccacatagccaagacaatcctaagcaaaaagaacaaagctggaggcatcacgctacctaacttcaaactatactataaggctacagtaaccaaaacagcatggtactggtaccaaaacagatacatagaccaatggaacagaacagaggcctcagaagtaatgccacacatccacaaccatctgatctttgacaaacctgacaaaaacaagaaatggggaaaggattccctatttaataaatggtgttgggaaaactggctagccatatgcagaaaactgaaactggaccccttccttacaccttatacaaaaattaactcaagatggattaaagacttaaatgtaaaacctgaaagtataaaaatcctaaaagaaaacctaggcaataccattcaggacataggcatgggcaaggacttcatgaataaaacaccaaaagcaatggcaacaaaagccaaaattgacaaatgggatttaattaaactaaagagcttctgcacagcaaaagaaattatcatcagagtgaacaggcaacctacagaatgagagaaaatttttgcaatctatttatctgacaaagggttaatatccagaatatacaaagaacttaaacaaatttataagaaaaaaacaaccccatcaaaaagtgagcgaagcatatgaacagacatttctcaaaagaagacatttatgtggccaacaaacatatgaaaaaaagctcatcatcactggtcattagagaaatgcaaatcaaaaccacaatgagataccgtgtcatgccagttagaatggtgatcattagaaaggcaggaaacaacaggtgctggagaggatgtggagaaataggaacatttttacactgttggtgggagtgtaaattagttcaaccattttagaagacagtgtggtgattcctcaagatctagaaccagaaataccatttgacctagcaatcctattactgggtatatacccaaaggattataaatcattctataaagacacacgcacacgtatgtttattacagcactattcacaatagcaaagacttggaactgactcaaatacccatcaatgacagactggataaaaaaatatggcacgtatataccatggaataatatacagccataaaaaaggatgagttaatgtcctttgcaggggcatggatgaagctagaaaccatcattctcagcaaactaacacagtaacagaaaaccaaacactgcatgttctcattcataagtgggagttgaacagtgagaacatgtggacacagggaggggaatattacttactggggcctgtggtggggtggggggctaggggagggatagcattaggagaaatacctaatgtagattgacgggttgatgggtgcagcaaaccatcatggaacatgtacatctatataacaaacctgcatgttctgcacatgtattccagaacttaaagtataataataataaaaagaacagatgatgtatccagaatgatttttttttctgtctataacctttagttagcaatttctatcaaggcaatgctaaactcattatgaacaggaaatagatgatacaaaacaaagcaaattaaaaaataggtctgggccaggtgtagtggttcatgcctgtcatccccgcactttgagaggctgaggggggaggattgcttgaggccaggagtttgagatcagcctgggcaacatagtgagacctcatctcttaagaaaaaaaaaaatttgccaggcatggtgtctcacacctgtagtcccagctacttgggaggctgagctgggaggatcatttgagcccaggagttggagactatagtgagctatggtttcaccactgcactctagcctgggctacagcctgagacccttactctaaaacaaacaaacaaacaaacaaacaaacaaacaaacaaaaagtcttaggagagctgattacagtttagcggaagcagccttttgactttcccttcttttaataccagggattttacttagattgcaaaactgtggatgttttgtggcaacttggagtctcaacatctattagcaaaaaagtaagaggattgtaattacagtctaagcttcggagctggttgggcctgacatttgagaaaatggataaggccagccctttgtctccctctgcccccacccgcttccctctctgggacccaagctctcttgctgcccagccaaacctgtcgtcttgagaaggcactgaagctgctgaccctttctgctctgcccaccaaaatataaccacccacagtctctgttcagagatggaatccagtgagatacctataatacattcacagtagatgtcagataatagaagaactcactcttctcatatcacatgggaaacacactgttgtcgcctttccatcctgtttcaacaattcagattatctcaagattcagaagctgcgatgttaaattaggggtcaactgtcccttgcccccctcccttgtgacctcactttcctgtctctcattgatacttgctgtctgcaaataacctggactctgggtacttttttcatgtgaaaggaaggattttgagctctttttggctaaagttgataagaaggattggaaagtagcttagttcctaattgaggttctctccctgtctctaaatataaatagaaaaactcatggaacatttgtgagagaagagttatatgtttagttgcttagaacattttattttagaaataaatatttagggatacagccattcatggtgttttcatgaacttatcccttatgaatgcatatgatatgttcattcacctctttgtagaagctttgatcgttttgcacaaaacaggaagtagtagtagtggcagtatggatttgggagggtgaagttagctttggccaggtgatctctgcatatcagactattaaaggcagcgcctttacagaatgttggctgggctgtgactcatgctttgctttgcactccctaaagaggctttatgtatcgcctctttgtcctttcccaagtcatttgaaaataaatagaagagagaataatgtgatcaggggctctaattgtatttattgcttatgtagggttgtagtagatacagggatgtttccttattctttatgtcttgcacatctgaaatgtgtcataataaatgatattttaaaaaactaaacagaacaactagttttgggaatttgtcctacatagtcatatgactcatctgcatagatcctaatatgatcatagcttggccatttccattttttctgtttttctccttcttaaacacaagtggaatttttattttatttatttatttattttttgcgtttttcaatcttggataggactagttgcttcccaccttttctgaggtacagaaaaaaataagtgcgtgctgccatttgcttaaagatcagcagtttccatctctgcaggtcagaaaggaagtgaatacaatgtattggatcaataagcacagatatttgcaatactaactataccaatttcaaaaacacagtaagttgtatatttaattgaaagttcagaaaggacaaacagtagatgacagctaatacagtttgaaaagaatgtttaaaatgtgcagacaaaagattatttgcctataaacaagattgataatttataatcatgtgatggattgaatctctttcataaatatttgaataagatgggatcaaggcagtaaagttgatcatgaagctttaccttgtcaatcctcatgagtgttgacaatacctgttgggaataaaccctgtagcctggctgaccaactgatatctatatcccaatccactggcacatcaataatttttgtaaagtaaaaagaaaaagagggagagggaactgtttgtttgatggtggatggagaaagtgtcccaggaaagaaagctacatgctggtgtcttagtggcagccaggaccaccctgtgtggacatgtagtttgtactctgcatgactcctgggggcatcattcacatagattcctaaaggaatgacgctctctatggttgtacaatctcagccctagtggtaatcatttatttggcaatctggaaatgtttccagaagtatcccttgtgaaggacaaaggtctactgtgtatcttgcatatttcattattaaccctgtgacttgtgctgagtaactacttaatatctattcagtgctaaaataagagaaaggcaactttaaaaaaaaaacctttttgagacataattcacatattataaagttcacctgcctatagtatacaatgatttttagtatattcatggagtagtgcaactatcaccacgatcaattttgaaacatgtcatcaccaccccacccccagaaaaataaacctcatgcccattaacagtcattctctgttcctctcttgccccagctcctggcaaccacttatctactttctgtccctacagatttgctgattctggacatttcatataaatagaaccatatactgtgtggcttttggtggcaagtttcttgcacttaacgtagtgttttcaaggtttatccatgttgaagtagcatatatcagtactttatttcttttttattgccaagttatattccactgtatggctataccacattttatttatccattctttagttggtggacatctgagttgcttctacttttttggctattatgaatagtgctgttgtgaatattcatgtacattttgtttgtgtggacataagcttttaattctcttaggcatatatctaggagtgaaattgctggagagaaaggcaattttaatttagaaatctctacattatttgcttttatatttaaagtcatcttattaatggtatatatctggcttggctggtaattctgggtcctgtatcaaacctccgccttacaatccccatccatgttgtgagccggtaggtgaaccacagaaaattgaaatgtactactgggttagtctctttgaacagggtcatacttacattgaattcactctgatttattattttgctactgcacttggaacacagacagtattcactaagaattggaactatagactagaaacagaggttccctgttttcattagtcaactctcaaaggatggaagcagccaatttcagactattctagggctcttgctctcttagttgcttgccatccttctttcttttggcctttttgcatttcattagtgtcacttacagagctaagagaacacagataattcatccaaagtatttttatagtctttaggtgaaaagaacttttaatatgtgtgtcatcttggtttctatgtcccttgtaaattatgttgtttaccctgaaactatgaagaagctgcagttgacttccttcaacctaatcttagcttctagtattgtgctattggagttattattgaggatgataaaaagagtgtatagtattgaaggcaaattgtttaagtgtgtaaattataatttgttttttttaaagggggttcactaacagactaaggaccatcagaaagatttttttaaatagaccatatttttagcaacgttacacatagttgtagtggttatgactttgcaaaataaacatcgtcttagaattgaggtcctagaattaatggacttaagtctgatttttaatgggccaaagctatttaaactgtacatgcattaacaattttcttagtggcatgtatacttgagtaggaggttataaagagtagacaatgagaatgatgctgtttgacttttaaagggaacattgtttcattggagaggaataaaatatggacttctctttaagcaaggcagtttgcatttctgttggccagatttcttgagaatgtgataaagcattagccccaccatttccagcatcctccatttaattcttcttagactcttttccacagaatgaaattgattgattcatggctgagggtttgaaaagagagccttggggaaaattttaagaagtgttccaggaggccataaagactgttgacaggtggccaagcccaggaaaaaagtattagtaataacaacagctcaccctacatagctcttaatcatatgtcaggcagtgcactaaacacgttacatgtactaactcatgtgattctcacaacaatcctatgaggtcaaaacttgtttttatccccaatttagatgaaggaattagggcacaaataggttaaggcaattgttcaaggtcacacagccacaatgtgagcccaggtggtctagttccagagtcagtactaaccactaagtgtgcagattactagaaacttggagacactccaactcctgaatatggtgcctagccagggctctggaggaagcaggcagggcagggcccaggtccctgccagcactttgccaaaatgaactggtgaactgaggcactgtcatgacctttgctgcttgaataatttcagacggcaaaagaagcccagtcatgtgaaattcctttgtggctagaagatgtcaacaggcacagatctagctcatctttcaagatatgcaattttttttcttaacagaatgaatgctcctgtatataatattgtcctttatggtggctggttcatagaaactgacaaagaagtcaaattaagagcagttaaaagttaaagatgtaaaagttaagtcacaagacccaagtagagtgagaagaaggtaatttgtgtgtctgtttaatccctggcatgacctttaatctctgctacttaaaaattacagatgcaatcttaactatggcataatgaaacaaagaccaccacttcttttttctttctgctttttgaagttgcgcagatgtcagaggaagataaataaatactgttaacagcttctggaagcataatgtgctttgaaagagtgagtcaaagctcgagccagggtttatggcctcagcaagtcgaggttttcctgatgacaaaatgaggccttggggttttggaggaagctttcttgaagaatgagcacagccaagaatggtgctacacttgggactctcctttgtcaatagaaaaagacaaaggacccgtttataaaatggatatcaagtagcagattagagggacatagttgtgtcaccggtatgatggtcgtaactgcaagttgtccaggttcttggtgttttgaacaaagaattggacaaaacgcccagcaaagcaaagaaagaatgaggcaacaaaagaacaaaagcagggatttattgaaaacgaaagtaccctccacagtgtgggggcgggctgagcagcagctcaagggcctggatatagaatcttcttgggtccaaatactccctagaagtttcccattggccacttcatgctcacttcatgtaaatgaagtggtagcatgcaatcagtctgattggttacagaaagccaaccagaggctgaagtgaagttacaaaggtcacactcctgtgcaaacatctggttggttgcaaaaagcaaccaatcagaggctagagtgaagttacaaagttatacttctatgaaaaggaagacttagccggcaatcagtctgactggttgtggacagcaaccattcagaggctggagtggagttacaaaattacaaatgaagacttgaccggcaatcagtctgatttgttgtggacagccagtttcccatctgacatgcagaaaaggcagggggtttgcaaagggagtagcttctggtctttttgtatttttttttcttttttttagtagagacgggagttttcaccatgttagccaggatggtctcaatctcctgacctcgtgatctgcctgtctcggcctgtcaaagtgctgggattacaggtgtgagccaccgcacccggctgcttctggtccttttattacttaggcatgaaaagttagggttttcctttcaatttagtcctaggaagttggcgtgaaacagccttaggttccctgcctccagaccctattctcctgcctcagttgaattgtatttcagcaattgaaatcagctaatcgaggacagacacctcatatatgttacccacctactctccctaatatgtagaatgcctatatataaaaataatagcaagaaacaataattacaacttattgacaccatgtgtgccctgtactagcatcacctccattttatgtgggaaagaactgtgttggagggtgaagtcactagcccatattacacaagtcttttaactacagagtcagctttcttaaccactggagcccattggggttggaataaggctttggaatatcttctggggttaacgggggaattcttgaaagttttctcaataggaaagtcacgaaaaagtggtatcgctgctggaaggcaggatggtttggcaacttttgaactgtggtctgactgtgaagtgataagagtctgaattaatatgctcaattagagtcaaaaggagaggcaagatggaagactccctgagaaggaatgggtgatccttgagacatgggcactgaccagatgtgggaattagggaaaggagggagtcaaagatgaatccaagatctccagagtagtgttagaatgcttgtgccatgaatagaaatggggaaataggagattaagccaatttggaaagacttcttggcctgtgttggtggcagggcactgccccacaaagcatactggttagtgggaaatgtggcagctctttcttcattgtcagagcctttgttttactacacagaagcttaaaacgctggatgcttgctttcctagactcccttgcatgtgactgagatccagtcatgaggcacaggtggatacttattggaaagatttttctctctgataataaaaagtctagcaagaaaaacctcttcctgctttgggtttcaaatgcaaggataccatgatgtcatgcgaggagctgctgcagccattttgcagtcttgagggacagaccaagaaaattaggggaagctgactcagagccctgacactggggagcccctgaaacaacaccaggaccgtctgcctctcttatgtgaaaaaagcaccccccaaccctggtcaagccatttttagatgagttattttgtgatttgcagccagagcatccaaattgatgcagactttgtgcaggtcacagatcaccttgatctgagctttgctgtgttttctattttggatattaattttggaaaaacaccatgtgggaaatgatcatcacaattgcccactgaagcctccaaaatagtaagagttccagaaagagagagagagaatgcactttggataccatttctagaaaatgagggctttttaacaaaagtctgtaaaggccgaacagcctggcccagatcttaggcccgctttgctgctaggtgagagcctctgttaggtttcaatagtgcaatgtgcttctcaaatgacaacggggcccattagtaaattaaacattcccatagcccctagatacaaactgggcgaaagaagtattttccgttttcagaactgctgctcttttcatttgcttcttcccaccttccttgacatttgctggtgtctgctgccaggaaggcatgtttagctcagtgatggatgtgcactaatgagaattagcctgctttgtggagcttttgaatcagagcaagtatgctgttctgaagggctgaatgactggttgattgaaaagtaattgattgcagaatttcaaaatgagattcaaaaggtacattacaaactagatttcacaaaagccaactttctttgtcatgttcttcttttcggtcattttatcctttttaagtttacaaaattattttagaatttagtaccaacttcaccatctgattcctgaagcttggggtattatatacatataaagtttatgataaattctcatgataaggaaaaaaaaccctatgctacatagattctagtcctgactccgcattaataactgccactcagggaaaattgtttaacttttctgagctcccattgttgttgataaaaatgtttgaataaatcatgcatgagatcctatacacgtgaacttagactttctatggtaagacacagattctcatattctacatggtattgggctgggggtcttccctatgctcctctctgagaaaacactcctgcagacagagagcaggcaaagaagcctcttgctagaggagtaatctcaacaaaatttggttttgatcgtgggattctgggtggagatgctagataaaagatgatgcagttgggcacggtggctcacgtctataatcctagcactttgggaggccaaggtgggtgaatcacctgaggtcaggagttcgacaccaacctgaccagcatggtgaaaccccatctctactaaaaatacaaaaattagctggccatggtggtgggtgtctgtaatctcagctactcgggaggctgaggcaggagaattgcttgaactcgagaggcggcggttgcagtgagccaagatcgtgccactgcactccagcctgggcagcaacaggagtgaaactccatctcaaaaaaaaaaaaaaaaaaaaaaaatgcctagttacatttgaatttcagataaacaaggattttatttttagtataagtatgtcccaaacattgcatgtggtatatttatactaaaacattattcattgtctagttgaaatttgaatttagctgggagtcctgtatttgtattggctaactctggcaaccctgattctgagaggaataattgatggtaatggcctgagcctaaattgctcaaaataagcaaagaggagctgcagaggattcttaggtcttgatagatatggtgtcctgggaggggctgagtaggttcggctaaaggtgaggggagtgaagggactaagatacatattaggagcctggctaggacgagaaccctccctcctttcttcctcacgcattcttaagtatctcctctacccactttgcttttataaaccttaattagctttaacgtaaagtgaaaatattggccgggtgtggtggctcatgcctgtaatcccaacattttgggaggccaaggtgggcggatcacaaggtcaggagttcgagaccagcctggccaacatggtgaaagcctgtctctactaaaaatacaaaaattagccgggcatggtggtggccacctgtaatcccagctactcaggagactgaggcaggagaatcgtttgaaaccggaaggcagaggttgcagtgagctgagattatgccactgcactccagcttgggcaacaagagtgaaactccatctcaaaataaataaataaagtgaaaagattaactttctatgataggctgtcgttttggcatcctttttacggtccttgttcctaattttgaaatgagtgggtggaccttatttttctcattctccctgctcacggccccctccctaattcaattaatatctgctggtgtgtgccccagattgattttttttttttttgccctctgtggactagttatttctcaacagaaaaatgattgccaaatttctgaaattcttttctaaacttctgaaccttttcaggtgttatttatgctcatcattcagttgtttgtacattcttcactcacatagcaaatctttaggaagtaaaagaattgcactagggttttaccctggtatgtagctgtgtggagcacttcagaggcagaattaacattgtgcgctactagttttattcctgtttgtcaaacaagatcacttaacacctctgcattgggtaaccatgctttcccatgaagcgagaggactgctgagcttgagcaatggcggggacctctcccagatggtaagtgttttagggcacaaggtcattatattaaaagtagcaagagaatgaacgggaatcaggcggaacatactgatactgacacatgtgtggcacaagaaattgctaaggtaggtgcctgatcgtaagggggtgtcccctccaaatattggcacttgaaagcagccacaaaacctggtattttagttatttatcctgagggtgagtagtgggagggacctttcgtggtaccctctgtgtggtgcttgctgtggtccttgtgttgtagcctttgatgtccaatgtgcaagatacagaatttggcaaatagaggtcgtttgtcaaggttggttctaaaggggctgcctaagtttgtcatctatgcaacataattcaaaggcctgttctgttaaaaaacaaacaaacaaacaaactcttaactacctcagaaccacgagtgaatgcagaacatttattcagaacagctttcttctatttaggcaccaaggctactaaaaagaaaatgatggccccaccatctgggagcttacaaaattaagcagatggttaaaatgcagtgtaacaagaggtgtggtgatagatcacactgggttaggagcctgctggaggcacgcagtacactgaggacttccgcaaagagagaagcctgtagacgcaggagattgtaagcgtggacactgtaaaagctgctattggtgccatgcccaggtccccttaactggattggtatccccagctgtaagctgttgtattggctgctgaggctcacagctgcactctcttgtggaaaattgtgttctgctgaaaggagcaaaaaaaatgaggttacataccttccccccagggatggcctagaaccaatgactgatcaataagaaagtacaaaaatctggccttcttgcatcaaagcagacaactctgtgtgcccttcctgctccagagatctgatgcaatcaggctgagaacagacttcagctggaaccacattttcacttctgtgcctttctgcttccttcattgccctataggattctcccaagaacatccctcagtacatcgcttgtaatgaatccctgtctctgactctgctcctaggaaacccctgatagcagagaagcagaagttgagctattctggtgttcagggctcatttttcctgatgtggggagagggaatagacgaagtggttgggaacattggtgaaggtctgatgtgaggcatgtgagcaatgtggagaatgggagcagtgtctgatatcaacttaggtgagagactaccatatgtgtatggcaccagtctgtattgtggtatcattttcttcagcactcagcagcctggggtataaaaacacagacatagatgacacaaggttgtagttctggcaggcggatgccataggaagtcaaggaaccaggcacgacaagaaaggacttgaagataggaaggaatgactagtttgagagaaaatggaggtgtcagtggaccaaagctgttcatacaatggaagaatatgtgtgatgaccaaaatacaggtaacaagtgtcaagattaggaggctaggctagtgtgttgagagtttggaacaggagaacttaagatttgaaggtttaagcatttctgcctaatgacatgtctaggatatgccacagcacaggtgtgtgagtgaattggagggtgtgcttctggggtgaggagggcagggcactgcagtgttagggagctggatgggccatcctcttggacactgccagcactgagccacagtagtggtccaaggaattcacactgcacatgcagctgttacctgccccaagtcccagagatgccatcacttcctgtgtcaggccttcgtggagcaggtgtccctaatgaaggcagtgggcaaagacaaatgacttggaggtatggaatttcccaaggagacccttttgtggtggtatagaaaccaaaccacttgttaacaggttaaatatttcccatctttctgttttcatgctgacataggtgttcttggactcattgaccctcctggtaaatctcccagtcaggagagttccacccttattggatctcattccatcatcctcctatgtatttcgacttgctgtccttgtctcctaatcatctcaatgacccaggcattgaagaatgaagagtgccatgatattgtaagagaagcagtttgatgtagtagacagggtcatgcttttccttctgcctggattgttccctattcccttcctcattcagtcaattcttactcatcctttccatttggcttaaatgtctctcttctccccagagtatttcagagtccacttctgtattatatactctcaaagcaccttattcccctttgtgactcttatcacaattataattaaacaaacaaaaagattatttcattgcttaaggtctatctgacttgatagcatgtaacctctataaggataaggctgtctgtgttatccctagctgctagcatggtgccttacataaagaatgtgcttaataaatatttgtagaacaaataagagacgtatatggaactgagagtccatttctgttttaaggcatgttcctatttagctgtgtgatcttggacaagtcacttcagctctctgagcaaaataacttcttactcactttaacattgtatgatttctgatttcacagtctatcagccaaacaccttaacaactcttaatcccaacagtatgtctgggctaactaaaagcattcatctggaacttcttaaagtagcttgttcctagagaaactatttttccttgtgtttcagtaatctctttctaagtaaaaaataattcccacatttagtggcttaaaacaataatttgctctctcaaataaacaagaaaaaagtaataataaagatcagagtggaaatcaataaaatagaaaaataaaaacagaggaacataacatagagactgtgcaatgtttggggaaagaatatccaaggcagaggtactgctaatccacaggtcctacagcaaggcatgcctgacatgttttttaaaatcagaaaagagggctgggtgcagtggctcatgcctgtaatcccagcactttgggaggctgaggtgggcagatcacctgaggtcaggaattcgagaccagcctggccaacatggtgaaaccctgtctctactaaaaatacaaaaattatctgggcgtggtggcaggcacctgtaatcccagctacttgggaagctgaggcaggagaatcacttgaacctgggagatggaggttgcagtgagccgagattgcgccactgcactctagcgtgggcaacagagcaagactccgtctcaaaaataaatacataaataaaataataaaaagataaaataaaataaaaatcaggaaagaggtcgtgcatggctggagcagagcacccaaagtgtatcgagcccctggtcaatgtgaggacttcggcttttcctttgagtatgatgggaaacccctggatggttttagcagggaagcaatgcaatttgaagtcatcagctctctccttctgtgtcaattatagtttgttctcttgcctctagtcatacaaagttgtatttccctggattgtgagacagaaaaatctaattctatatgatcagagataggctgttgctttgggcaggtttttatttcatgtttatagattaagagtttgcactttcagttcccagggagttcacacagatggggtgactgctttgtcttaattgcaattgtcatgatgtatgcgtactttcctagaactggactgaggctcagatggatagatagttcaaggaagatagattaacagagagagggagggagaaagaaagagagagagaatagattaaatggatggatggatggttagattaacagacggacaaaataaatggatgatgataggaggaggagagagctcgtcctctttgaggcagtgtataaggaggactggttgactttttctttctttgtgaatcacaaacagagtttagaagtggtatgttttcattaacgctaccttaattaatatccccttaatcatcaagtatattccattttgacaaaatagaaactgaattccttcttatctcccaaaggcaatggaaaggctagagagagctggcactgtgctattacaagcagatgagaggcatatttgctgaataacgagagtagctaacagtactgaactttgcccttttggtgtgggactctttctttcctgaatgttcaataatgtctggctcttttcctttgtgttctggttttatgcaaacacaaattacactcttgttgacttcactgtaacccatgaaattaaagaaggggaaattggagtcctatagaaggcagtttcaccagtcctgcctcttggatttgtgcgatggaaactgagaacagctgtatttttctaaccaattttatgagaaaagaagtgtccccagcagtaatcagcacaggcacatgataggaacagacagagatgctgctttaaaatcatatattctagagctgaaagccatctaagagagcatccaattctccctcattgtataaatgaagaaagtaactaaaactcggaggtacctgttcacacttcttgagtatatactaattatgggaagcaacgtggcatcacagaaataccacaggccttgtggaagtctgtgtgggaatcatagctctgccacttcctagctgctgtggctattgggcaaattatattatctctttgagccttctctcatctgtccctgcttcatgggctggttataagaatcacatgatataaaatataaagccctggcacaaagtagatagttaataaatagtagttatgattagctcgcttttgttgctagtgacaatacagagtaaaaaccatctcagcaaatacttagaataggattttaaaatgtcaaccaatggcaaacttgtttgaagtaaatttcaatatactgaaattccaatataattcagggaaacaaacatttttatataaaatattgtgctatacactagagttagttcaaaaataagaacaagatctgggttctgcttttaaggaaatgagagtagacatgcacgctaggctgcctttcagtgagggccgtgggacgggccactggggaggaggggacatgggtctctgggtgcacagaagaggttcttcctggacaaggagctcagggaagtcttcacagagaaagtaacattcgagaggtttttagaagggtctagaaaaacagattgagggacattcttattgaagggggccccataattacaaatacaaagtatatttagatttaaccaactcctctgtttaaatgagcatagaatatgtgaagggcaaagcttaaaataaaaatgatagctaccacttacggaattcactcatgtattcactcttttgctcgttgtgcaactctgtgaggtagattattatctccattttgccaaagaggagacaggcatgggcaggttaaatgtgttgcctaaaggcctcacagctggtaagcagtaccaaacttgaattcaggtcatctgacttcagagtccatgctccagttcggacattagacagtgagcttgactttttctgctagccgctccagatctataccctcctcttctccctgctgctcggggacccaggatgctgagctgtgtgggctctgtcagcatgctcccttggccctggtttcccgtcataataatggagggaaatgggagatggggcctcaggtttgccagggctgtatccctttgttagaggacacagctcctgttggccagccgctcttgcagctacaggtctccctgtgttgaaaaactcttctgtctccttgtcccaggacagctaatgctagcctcagaacacttcaccatctcatgttggttcctttaaccctgtccctgtctcagtgaagatcggaatttgggggttataggataatctgttcagctttagtggatactaccaaatagtttcccaaagtggttataccattttttttcctactagcagtgtaggaaagtttcagttgcttcccccttttgccaactcttggtattttctgtccttttcattttagccattctagtgggtacacagtagtatctcatttgtgatttcagttttcatttctctgagaactatggaagttggataccttttcgtgcgttcattggccatttgaatatctttggtaaagtatctaaatcttttaccctttttcttttctctttcttctccctctctctctttttttgtttttgagacaagtgtctctctattgcccaggctggaatgcagtggagtgatcccagctcactgtaacttcaaactccttggctcaagagatcctcccacctcagcctccatagtagttgggactacaagcgcacaccaccacacttggctaatttttaaaattattttgtagagatggggggtggtgaatcttgctatttgctcaggctaatcttgagctcctggccctcaagaaatcatcctgcctcagcctcccaaagtgctgagattacaggtgtgagccactgtgcatggcctttttgcccatttttaaattagattgtcttttcttttggattatgaagttatttatagattatgagtaaagtcctctggcagagatatgtattacaaatatcttcactctgaggcttgccttttcgttctcttaagcatatatcttttgatgaagagatgtttttaattttaatatactctatatattttgtttctttgtgttactatttgtaaaaataataagaaatacacatattgctctcggcccacagtccctgatacagagctcttaaaacccttgtaatttcctaagcaataaggatgctaggagaaccttttgttctaatattcgaccttttactctggttcctgacttttaaagtccttaggaattttagagcttttaaagtccttaggaatttcctgggcggcaggagcatcatttaataaggtagctcttggtggactcctggatgggagctggtcaccataaagactaagccataattataagctggggtctttcagccctaatccaccaacttgccacaattctccagagaagggaaaggggctagaaataaagttaatcactgatcatgtctacgtgataaagcctccataaaaattcctaaactatgggattcagggagcttctgggttgacaaacacatctgcatgccagcagggtggtataccccaacttcatgggcataggagtgcctgcacatgggaccctttcagacctcgccctatgtatcttttcatctggccagtcatctgtatcctttattatatccagtaaacataagtaacgtatttccctgatgctatggtttgaatgtttatcccctccaagctcatattaaagcttaatccccaatgtggcagtattgagaagtggggtctttaagaggtctcgagggctctaccctcatgaatgaattaatccattgatggattaatgggttattacggtactggaactggtggctttataacaagaggaagagagactcagctctctggcatgtgatgccctgtgccgtctcgggactctccagagtccccgccatcaagaaagccctcaccggatgcagcccctacaccgtgggctccttagcttccataactgtaagaaataatttccttttctttataaattaggcagtttcagatattctgttataagcaacagaaaatgcactaagacacctgagttctgtgagacactctagcaaattaatcaaaccaaagtggaggtcatgggaatccgatggatagctggtcattcagaagcagaggccacattctgtgcttgtgactggcatctgaaggggggtgggggcagtcttgtgggactgaaccctcaacttgtgggacctgacactatctccaggcagatagtgacagaattcaattgaattagaggatacttagctcgtgtccactgtagaatctgccagagaattgcttggtgtgtggggaaaaccccccaccctctggcatcagaagtgttgaacgattttgtgagagtagagagattcgaagaaccattggttttacctatatccttacatggctttgtatggtttttaaaaaggcatgtttgctgctacaatatcataagaatgttttcctgtgctttattctaaaagctttctggttttatctttcatatttggatctgcaattcatttggaattgatttttgtgtgtgatgtgagattagagtcctgatacgttttttctctcgtatggctatccagtgaacctagaaccttttatttaaaatattctcttttccatcagttcactgcaatgtcatacttttcatgaatcaggtgactgtatacatatggttgttttcttgtatgctatgttctatcccactggtctatcttcttgtctatccttgtgccaatattatacaatcttgattattatggctttataatgactcttgataactggaagtggaagtcttccagctttgttcttgaagattgcctcagctattcttggtcctttgcattttcatatgtattttagaaatagtttgtcaacttccacacacacacacacacacacacacacacatgcctagagtttggtgaagattgtgatgaatctataaattcatagaaaattaacatctaaacatttcaattcatgaacgttatgtttaggtcttctttaattttcccagtaatattttgtggttatcagtgtaaagttcttatacatatttcattagatttattcctatgtgttcgatttgctatagtaaatagtattctttttaaaatgttgtcttttgtttgttgctattatatatatatattttttgagacagggtcttactttgtcacccaggctggagtacagtggcatgatctcagctcactgtaacctctgcctcccaggttcaaacaattctcatgcctcagcctcccaggtagctgggattacagacgtggaccaccacgcccagctaatttttgtgtctttagtggagacagggtttcaccatgttggccaggctggtctcaaactcccgacttgaggtgatccacctacctcggtctcccaaagtgctgggattacaggtgtgagccacggtgattggccatataattgatttttgtatattcaccctttgtctagtgatcttgtaaactcagcaaagtatatctgtggaaggcatttggtagatatcctttattagtttaagaaaattatcttctattctgtttttctacacttttgtttaaaaccatgaatgtgtgctgacttttattaaagacttttccatctcttaagatgtccaaccctgttttgactcagctctaggacccaattctatagccctttccctggtcttggctttatccccacaatcacaaaaactccatgaacaaaaaggaacaaacaaggacctgaaccgaagaagtgccagtaaacatggaaaggaagagacaactgtaagagattttgatgttctgcaatataaatgttttgtacagtcccagatgtgttgagagagaagccgacttctcaaaaaaattttttttttttgaaacggagttttacacttgttgcccaggctggagtgtaatggcacgatctcggctcactgcaacctgcacctcccaggtacaagcaattctcctgtctcagcctcccaagtagcttggattacaggcatgcgccaccacgcctggctaagttttttgtatttagtggagacagtgttttaccacattagtcaggctggtcgtgaacacctgacctcaggtgatccacctgcctcggcctcccaaagtgctggaattacaggcgtgcgccaaaatgcccggccgacttatcagttttttaaactcctgcctccttttgataaacataaaaaatccacatgaaacttttgtttaatgtacgtattatggaaacaataagctattttccaaatataaattttaatatgattaagctttttgaacttttaaatatagattgcccttattagagattaataatatagtatgtgtaaaagcaaattacacattctataatcccctgcccctaaagtccgatacatcctccctgaaagggtacttttctccttcactttctcctaattgaaactcactgaaatagcatctacatagaacatcactgcatggtggagcggcagataagctggttaagcaatctatcattactatcatctggatgtcccaggatggttggggtaagtagaaatgtatgaagactctaactggcaatgggattttatcattgaaaagtgcagagctggccaattcagacccaagttgcaggtgtacctgggagaatacacacttgtaggttttcaaatttactaatatttaagcagtttgattctctacaattacttcaacatttgactattgggcttgaatttaatgaatcctggtgccctcttgtggacatgagagaatgtacaaagagtatagctttgagttcttttcattttaaggattactttgtgtacccatgtcccattaacctaagataactcaataggtagaagatctcaagtcacacagccaggcataatgttgccaattataagccctgtgaacttaagattccttatctgataaatggcagtaacaatagtacccaccttactaaggttcttgagaagattaaggatttaaggaaattcccttccattcctactttcctaagattttgtttgaaaccatgaataggtattgaattttatcatatgttttttctgcatttttaaagatgtacacttctgttttgactcagctctgggacccaacactacaacccttctccaggcatggctgtacccttactttatacatccatacatacaattggccctctgtatctgtgggttctgcatctatggattcaaccaaccacaaattgaaaatatttgggaaaaaaataataaataataatacaacaataaaaataatacaaattttaaaataatatagtataacaactatttacaagcatttaccttgtattaggtattgtgacttttttttttttttttttgaaacagggtctagctctgttgcccaggctggagtgcagtggcatgatcatagctcactgcaaccttgaactcttgggctcaaataatcctcccacctcagccttccaaagagactacaggctcatgctactatgcctggctaatttattattattattagtttttgtagagatagggtctcactatgtctccaactcctggcctcaagtgatccttctgcctcctcctcccaaagtgcttgggattacaggtgtgagccaccatgctcagcctagagatgatttaaagtatatggaaggatgtcatcaatgatagactggataaaaaaatgtggcacatatacaccatagaatactacgtagccataaaaaaggatgagttcatgtcctttgcagggacatggatgaagctggaaaccatcattctcagcaaactaacacaagaacagaaaaccaaacactgcatgttctcactcataagtgggagttgaacaacgagaacacatggacacgggttggggggagggcatcacacaccagggcctgtcaggtagtggggggctgggggagggatagcattaggagaaatacctaatatagatgatgggttgatgggtgcagcaaaccaccatagcacgtgcatacctatgtaacaaacctgcacgttctgcacatgtagcccaggacttaaagtatgataaaaaacaaaaagtataaaaataaagtatatggaaggatgtgtgtgtgtcatatgcaaatactataccattttatataagggacttgagcatccatggattttggtgtctgtggatgagggggcctggaaccaatccctcacagatactgcaggatgtatcttagcctggcacatagtgggctctcaataatgttatctgtgtttagtatcaatcatcttaatcaattatcaatcccttaaaggaaagggaagggtatgaaggatatagtatcccaaaacagagtggctacagatactagtaacctctcctccccagtcccatcctacctcattcctgattccctgcagcaactactcaactctcaactatttctttttatatttatcatcatatttttaataacatgttttatggatcttcttcattttttttgtccatatgtagtattatctattgactttctattatggaagatgaacgtttaactctcttacagtactccctccatacttcctttcccccatttatgatcccatgtatgtaaaaataatgtactctattttatatatttggtcctctccataataaccaaaaatatggaccaaggcataaaaggtgaatactaaaaaacggaaccttgtttcacattattaatgtcaaataagcctgaactcttcttaaatgaagcaaagaaaaaatttataatgaaaaagattataatttgcaatgataatggagttatcacataactttatgcaacaaggaagaagaaataaaaggagaaggttttaatcacctttgttggtccatgtctgatcaagcagaggaaaactaaaaaggacataaaatatctaaacaatttaataaataaatccaaatgtgattccagatagactcatatgaccaaataacacatgcaaatattgaccttatatcaggttatagagaaaactgttttccaaagcagctgcaccattttacactctaatcagcagggccaatttctctacatcttcaccaatacttgttattatgtctttttgatcatagctgccttagtgggtatgaagtggtatcttattgtgattttgacttgcacttatttaatagttaaagatattgagcatcttttcatgcacttttggtcatttgtatctctctttttttttttttttgagatggagtctcgctctgttgcccaggctcgagtgcagtggcgtgatctcggctcactgcaagctccacctcccaggttcatgccattctcctgcctcagcccctcccgagtagctgggactacaggcgcccgccaccatgcctggcctggctaatttttttgtatttttagtagagtcagggtttcaccatgttagccaggatggtctcgatctcctgacctcgtgatctgccagcctcggcctcccaaagtgctgagattacaggagtgagccaccatgcctggccggtcgtttgtatatcttcttatcggaaatgtctatataaatcctttgctcattttaaaaattgaattgtctttttattgttgaattattattgaattctaagacttgtattgtagatgcaagcccctatcagatacatgttttacaacaattttctcccattatcagggttgtttttgtattctctttatgttgtcatttgaaacacagttttaaattttgatgatgtccaatttatttttttcttttattacttgtgcttttgtaatcgtattcgagaaaccattgtctgattccaggtcatgaagatttatgccagtgttttcttctgtaagtttatagctttagctcttacattcaggttttttttgatattttaactttttgtctatggtatgagctaagggtccagctttttctttgatctgtggatatccagctggcctaacatcatttgttgaaaacattattcttttccccatttaattttcttggttcccttgttgaaaatcagttgaccataagtatgagggtttatttctgaactcacaattctattatattctatttatgtctgttcttctgccagtaccatgctgtcttgattactgtggctttgtagtaagttttgaatttgaaagtatgtcttccaacttctttcttctttttcaagattgtttggatattctgggtcccttgagtttccatatgaattttaaaatcgcttttcagttgctgcaaagaagccaagtgagattttaatagggattacatttaatctgtagatcaaattggggaatattgccatcttaacaatataaagccttccaatcaatgaacgtgggatgtccttcatttatttaggtcttttaaattttctttcaacaatgtttcatggttttcagtgtatatgtgtcatggtacatttttgctgccataacaaaataccttagaccaagtaatttgtaaacagcataaatttgttgctcatagttatggagtctgggaagtccaggatcagagcaccagcagattcagtatctggtgagggcttgccttctgcttccaaaatggcaccttgttgcttgactttacatggtggaaggcggaaggacaaaggaatagagcccttccttcaacctgtttcatgacagcactaatcccattcatgaggttggagtgttcatgacttaatcacttcccaaaagacacacctcttaatactatcatactgactattagatcctaacatgaattttggagggacacatacattcaaaccatagcaatatgttttgcatttcttttgttcaatttatttctaagtatgttcttctttttgaagctattataaatggaatttttttaaaatttcattttcagattgttcattgccagtgtatacatatccccccctccgaatccagcatccacaatatttttaataatgacaggatccggttagtttttgtagtacagctggcctcttggcctctggtgtagggtttggagtagctgtgcaggtacctggggccttactgaaatgcttgtatatttcttggtccttgtgaggatgaaagagcaggacaatgcatagactttgggggcgtccaggtcaggaccttgccctccaattatgatccccacaaccattcattttgtgttcttggccaggaaacttcattttcttgatcatctggcctgttgctgccactcatgaatatcctctacagcacaacttggttgaaggtggagttggttcctctggccagaaacatgtaccgcttgaccaacagctttagatcaatttcctggctcttgagtttctggcactgggttccttgtggcaggtgtggactcccatgatggtgcctcctactcagccatgtccaaaaaagtgagcactctcagactctttaaatactttatttggaatttttggacatttacccaatttttacctaattttttccatatagaattacacatattcagaagtgagctaagagtctttttcttattggatcatttaggttaccttaggtctgaaattctcagatatgtattgctctcatctactagatccttgaaatttgccaaaatttaaattatttttggcaaaattgagcaaatatgaacacttccaatgtcagtgaggaagtgttaaagtgagtacttccatatactattggtgggactgtgaaatggtgcgggcactctgaaaataagtttgccaataccaaaatcctcagttaagattgtaattttagaccccgtacttttccttctataaatctatcattaaaatactgagatccagaccaagatttatatataagacctcctcagtattattttatagtacaaacgtgttgaaatcaatttcaatgtgccataaaaatatttatctatgcattaaaaaaggctgaaaggaaatatatcaaattgtaataatgttatctctgaagaatgggatgaggtaaagtcagtataatcagtaataaaaaatgggggcaagagcacagattgtactagttacagacttgagtttgagttctctctctgccagatgtagctgaatgactttgggcaagttacttaacctctctaagcctcaatttccttaaatataagatggtggtaataatagttgttgccttatagggttactgaaagaattgagtgagatatacacaaagtgcttagcacagcagttgatccacagtgagtgctaagtgttagctctcgttgtcattggtcacctggccttgtcatatacaactgcacaatcccctggaaatgtttccactgaatgagacacctatggatttggacagactggctttttctgccatgtacttcaatggccttagttgttgaggactcgatatgtgcatgtgatgtgagtgtaattgaccagagaggtagtgtggcacaggggaaagaacaaggagactttggtcccaatctaggtcttggttccctcatcagtgaagtgaagggagctggactagagaatttctaagatctcttctggctctaaaatgttcatttctcaccaggcacggtggctcacacctgtaatcccagcactttgggaggccgaggcaggtggatcacctgaggtcaggagttcaagaccagcctggccaacatggtgaaaccccgcctgtactaaaaatacaaaaaattagccaagtgtggtggttggcgcctgtaatctcagctactcgggaggctgaggcaggagaatcgcttgaacctgggaggtggaggttgcagtgagccaagatcacgccactgcactccagcctgggcaacaagagggaaactccatctcaaaaataataataataataataataatgccacagcaattgtgaatttagacttttgtctcctaaacacaaggtggcagcaaaagactaggctcttggctgccatttgccaaaaccagtaggataagatggtattatttaatttacactatgttataaagtaaaagatctaggtggcttaagatcactacctgctcttagtggtttctatgaggcccaggtttaatgtccctagaattatgcttttatcgctataatcggaattcccctactctcaatatatccactgaagtcaccactcaacaacacctctgcctacaatttctccaaggctttttctatcacttctactgcttcttggaaaaatacccttcaagttttcacctgtgatgagcaggggtcttgctggcagaatggcagctatgtgctttacaagataaaaacaacttctgtcttccaggatcggggaggatttgcagtatgggggcttggtagtgctctctcagggaaaaaatttcaaataaaacacccatgtgttgccagtctattcaaatatgttccaattataaacaatagtaggaaatctcgatgatctgtgggttgggtttctgtgttccttggttggagctgatcactcctggccaggtggggctggaaaaggatggtgagaaagtgggagacagaccatgaagtgagatgggaaaccccattgcagaaacggagtgaggggcctgtcctcagaatctaaagaaggttgttctgaagatccctagggaagaggccaggggcctagttgagacacaggtgaggtgaccctcaggagaatattttcaacctgaggtccgagggagtgggcctgaggcctaaatagaaagatcctctttcttcagggaccttggggatttccaggcagaagttgacctaagagaggcagtgggagtagaatggaagggctaaaaagatagggccaaaggtcaagttaaaggattgacatgtagactagaaggaaattgacacaagtaccaggaagaagttgtttaatggttctgatagatgccacatgacttaagcaactggaaactgaccttgcaacccctacaatggcattgggctcataccctgagattccaaagcagaggggatctccagaggagaggaaggagggcaggttataaacagagcctttttttttcagagaggatcctcttccttcttttatttccttcctgctaagtggtaagagcagaaaatcattaaggaaagcagcagaagaaactggcagatctggaatgtgggccattttctcaccacaatgtgggcttcttcacttccgcaggattctacctgctttaggggtcacaccctctgcagggtgcttggggatcgagggacaaggagggaaaatgttttaacctttaaactggtggcctttttggtggttactatctaaattacctccaaaatgattgggggtgggaaggggaaagaaaacctaacctggacctaagggacttgtggtagggatcggatactgcaatgagcgtggaatcatacatttctctttcaacttgatgaggtgctcccacggagggacagttagcagaaaatttggtaaaggccttatcacagaccagagatatgaccaactggggtgagctttaaggaggaactagggtagaaaatggttaatgttttgctgaaatacagggaagaaacaaggtggattggatcataaccaacttctttcacaatgtcataaaagtacccaaactgtggagtgcacccacatctacatgagcaagtcttgtgaattgctttgatgcttgcaccgtgccatctcaggcctgccatggtgctaagtcaccctccacagatgcagggcttccagcttccacctgagagcaggagcagtaggttaactttgtgtcaaagactcatccttcctttcctttgacttcaaaggtcccttggtggaactttctactgtcgggtctttcatgattccctatcagaggttttacatgtatgctttcgactctgaaagggagacaatgccagctaaacacaaggaaagctgttcaggctgagtgtgggagaaggggaagctggttgctgattctaattctgatgtttgaggggaaaataatatgtttttttttttgagacagagtcttgctctgttacccatgccagcatgatattggctcactgcaacctctgcctcccaggtttaagtgattctcatgcctcagcctcccgcgtagctgggactacaggcacctgccaccacgcccagctaatttttgtatttttagtagagatggggttttaccatgttggtcaggctggtcttgaactcctgacctcaggtgacccacccgtctcggccttccaaagcactgggattacaggcatgagccaccgtgcctggctggaaaataatacttctatctcactgatcacatttaccggtagtatgctttaagcaggaaacaagaactgggtaattgcggcagaaaagcctttaaaagaaaatgacttcattggcattagcaaacacctacagagataatatctctgaccttagctggcaggcactgagaaaattctgaggaatagagggggagtctggaagacttgggactttgatttttcttatccgggtcagacattgatctttaaaaaatgacatacgttttatagtcattaacttatcacttaaaatgttctgctgctacagttcctggagtaggggtagaacccttcagtttattgaggaccaaagacctacattaaaagtaaatcaaagcctaaagggaagcaaaaagcaacttaattgacttcaaaaatttttaagccgttcactggtttaagtaaaaaatatgaagcatagtaacaattttcagccactctggaaaacagtttggaagtttctcaaaaagttaaacatggacttaccatatggccaggaattgcactgctaggtaaatactcaagaaaaatgaaaacatacatccaaacaaatgttcatagtagcattattcatgatagccaaaaagtggagaaacccacatttttgttaactgatggtgaatacattaaatgtggtatatcaatataatggaatattatttagccataaaaaagaatgatgtactgatacatgctgcaatgtggagaaaccttaaaaaactgaaagaaggcagacaccaaaggccacatattgcatgattccactcatatgaaatgcccagaacaggcaaatccatagaaaaataaagtacttcagtggctgccaggggctggtttggtataggggagaatggagtaggactgcgagtggatatgaggtctcttttgggacgatgaaaatgttctgaaattagatagtggtcctagttccacaactctgtaaatacactataagccaatgaactgttcaatgaaaaagggtgaattttatagtatgtggatttaattttatgatatgcgaattacatctcaataatatatgaagcgtgaaactttattcaataaatatattaaacatttaaaatataattcaattaaaattaaaaatgaagtatagggaaggagaacaagacaacgaggaaagatggaagagaaaatacttggctcaagaaagaaaatgagctgggtgcagtggctgacatctgtaatcccagcacattgtaaggccaaggagttcaagaccagcctgggaaacatagtgagacccatttgttaaaaaagttcagatgtggtggctcacacctgtaattccaacactttgggaggccaaggtgggtggatcgcttgaggtcaggagttcgagaccagtctggccaatgtggtgaaaccccgtctctactacaaatacaaaaattagctgggcatggtgctggaagcctgtaatcccagctacttgggaggctgaggcaggagaattgcttgaacccaagaggtagaagttgcagtgagctgagatcacgcctctgcactccagcctgggtgacagagcaaaactctgtctaaaaaaaaaaaaaaaaaaaaaaattagctggatgttgtggcatgtgcctgtagtcctaactactcaggagcctgaggcagaaggatcagttgagtccaggaggttgaggctacagtgagccaagatggtgccactgcattccagcctggatgacataatgagaacttgtctgaaaaaaaaaaggaaggaaggaagaaaatgaaaaccaaacaagagaagagaggctgattccatgattttcaacacaatagaaatttccattgttctctgagattcccttgggctctggtcttcagaatgttattgttattattattatttcctttagaacttctaatgagcacattgaccattgcttccaggttttcgaattgtcctttgcccttaaactcctcagtggcttgggttttattccaatagagcagaggatatgaaatatttcttggttaatgtttctgggtttgcagtatcagtcagtgaccagagttggattttacgtctaaaaaccatataaactcaagccgagacttgtctgggtgtagacttcccattgccaaatttaattttattatttaaagtcatgttgagaagtcatgtaggtggtctttcttctaagctaggacagacttatcagtctcacttgcctggtactactttatgaggtaaataattaatttgagatattaggcataagctggtcttgatctgttctcaaactccaggtgggtagaaagctcaactgttgacacagggcctggcatgggaaatgattacatgggaagccatgtctgataaccagaaatgatacttcataataacacaaagataatgagagagattgggagtcaggttagtgtgtgaaactagcagtagaccgagagggaaagtgggttgtgatccttctttgaagtcaccacagagtctttctgctccttcacccactatggttagtgaatgaccaaggatactgactttacctcctactattactcaaatgtatatctcttctccgtcatttctcctgttcagttcctctttctctctagcctggtcaattgcaatatctttgtaacatgttttctagactgtaatattgctcctattatccatccttccaactaggaaagtaatattcctgaagtccaaatcatgccatgtccctaccttattagttctctgtgttgagatcagatgaagctataggcagagatgctcttatgacatgaaggactggggttcccttgtaagaccatcagaatttgccctatctaagcccctactcaggagcctagaggaatccctgaactgaatggtctgagtcagctgatactctcagataacagcactttgctcataatatatgaaaacaggagcatgatttagaaaaaaaaaaggaaccaaaatcaccagctaatagatattatgcaataagcacattacagaaacacaaagtcctggtgtacatcaccagggcagtccctgaggacagtctagccaataactacacttaagttgggtctccagatctgattttctaagtttctgatcctggatcctttcataaattatagctgctacctccaatcccaccccaagtctcatgaacaggaaatctgtgaaaaagttttacagggaggtttgagaactccctctgagctagccaatccagagtcttgctttcagccaagcttccatcatacccagattttaatgatgagttatttatgttctcacttaaggaaatcctttcctaccctttggaacttctatttatcttgttattaaaactgtcttcaaatagatttcctgctgcaatacaacacacttggtgactttctcagtcttacaatgggattagatatttagtgctgaaaggatcattgcaaggagagcaatcaggtttcttctcagtgacaactgcttggtcttctttgctgtaaaagaactttgctttgagctttgatacatggaaaatgtctgccagaggccctggtgagaaagagtccgtgtgtctgcccatcttgggtcatacccttgtcatccaggaactaacaagtcaccccagtttacatgcagttggcattggatgggtgtaggcaaatcacctggactatcaaagatacagtgtctaaaaaaggctcacttcctccctatcccaggtggtaacactgcatcgcaagtacagggcatcccaaatacagaacatccctaaccctgcatgcccagggcactgttctcagctctgctggtctgaccaggtagtttcacagaattcttgcttggttaacttgtagttttttgacatgatgtgctagataggtaagatttaggattcttatccatgtaaatgaaacttaaaaagaatttctcctgattgagttgcttagggtttttgtttgtttgtttggtatatatatatatatatataaaggggatgttagggctgtagtcagtggctgattatttgaaaatttcttcaacaatatgggttctgttctgctaattctcagaccaatgagggcctgtgtatgctagcagagagaggaaaagactagggttttcagattaggactctgggccagaatttgttaccatgtgaccttggaccactcatttaaccaaagcttcccagccattccccgtggaaaggaagtggattgaatgacctcccggtagcctcaccgggatattgcggctgcagcagagcaagggctgcatatagaagaggaacatgaagactttttccttacaaagtaaatgatatgaattgactgtggtaaagtttctaaatcagattttttttagtccagagggacagcttttaaaatgagagatttatttaagttataaggaaatatctgtcaaccctcagaaattgcaagatgattattttggttgtgtgtgtgtatgtgtgtgtgtattcctagtggagggtgagagcttgactcttaagaatcatataaaatatcaaattatctcaacttctgataaatagggggaaagacagacattttggggaggttcaaacctctataattctttaggcatttaaccccccaagagcagggactacatttattcattcgtagtgtcctccactccatatcagcatctggcacctaatatgcactccataaatctttgttgtggttgaatgagatcattttccccatgtctttgaaagacagaggcaaaaacagagtgttctcattaatggacagggttttatttcattttctttcccctcccccctccttcctttttgcctgtctgcctgcctgccttccttccttccttctttccttccttcctaccttccttccttcctaccttcttccttccttccttccttcttgcctgcttgcctgcctgcctgcctgcctgtgttaaataatctgaatgatttcaaagaatcaaaaatggctgttcacatttggtagggttctacggagcttatctaacatatttctaaatgagtactgtaacacatctggggccaggcacccaagcctgttcctgtgtactctctcatttgcctagaaaacataaatactgatacaggtcagggaagcaaactcttgagggctgtattaaaattctttttattgcaagcgatgtaaactcaatgaagcaaaaagaagatatttattgaaccagtacaaaaagcgcaagggcatagagattacataccctagagatcactggaagtggaacaagaatggagctaggagtctccttctcctaacactgcctctctctgcttgttttcttcattcacaccacagtctgggtacacagctggtgaagcctcaagatgcggcatagccttgcccttggaagagaactgagagctactctctggttgtaagtgaagaaatcccagcaaaggcttctggttggttaggcttaggccacatgcccacctgggtggccagtgaaacactatggttgggaaaaccttagaatcactgactgtagacgggagggctattcccttaaaggagggatgcctttcctagaaaggagggtgctggataaacaaagtgcatctctaggggtcagggagtagtcatagaaactatggaccaaaagatagcatttgctgaccaagaggccccagtttactcctaaatgttcagagggtgcatttaacttcagtgacttcaatcaattctgtaaattttggtaaacagaaaaaagcagaagaaatagacaaaatagaaaaataacaatataaattatgcaatcaattcagcctgatagtctactcactgagtatatgtcctaaagcaagaatcaggaagataatgaatcgcagttggtctcatttccccccagaacaaacatcttttcctttatctagtactgaaccagaaaagtagagggccgttccagtgctggagggaaactgtgctgggcttatgaagaggcaggtgccaaaatagtgccttcctagaagatttttcaggacagtcttgactatatgtgattttcactgtatacactgatgaattttagaatttaaacatccataaaacacggtgccttttaggctttttgtatgtgcatctgggtgtattattcagaatgaaatctctttactgaatctttcctatttatgagaattgggtggaaatgatcaggacaactaatgagtggatttgtgaggtgtgaggtgtgacaatattgtaacggaagattttgtgttgagcttcttgtgttttaatcatttcttgaaattctgcttgatgctttaatggatgtatttgattatagacacacaagactagcttcttttaggtcatctaattccattgtccagctaatccttacaacccaaaatattatccagagtggaactgaatactccagtaatcagggacacctcccattcaaagcaagcctttgatcttcagataactctgaccattaaaatgatgtcccctgtacattaagcccaaatttgaattcctataatttatactctttgatattatatctctttccagggtcaaagagaaatcatctaatccctctgcctcttggcagcatttcaagactttgaagagaccagtcatgtcgcaacaagtctctctgttatcttcccttgctttattttcaccaactgttgatgatgatgatgataacaacactagtaataacaattaacaataattgggtgcatgttatgtgccaggtgttctaagctatatatatatatactcatacaaatctcataaaaatcctagaaggtattatccccattttacagataaggaaactgaggcccagaaaggttgcataatgtggctcagagaggcgcagagagattagataatgtgctcaaagttatacagctagtgagtaacaaagcctaactttgagctcaggcaattgggctcctgagccttcctttgctaggtgacactactctgagtgtgatccaggttgtccccatttctcttagaataatgtccagaagtggatacaatcctacaggatctgcctgccatgaactattaatgccactcaagttttcattagccacatgctacacctccttctaaacattgacgcaaagaggagctcatccacttccttaacaaatgtggttatacctatgctattttcagtgtgtggagttaattcacatcaagccaatcagatcaatcaccacagctttttccccaatatttgggcagctaaagctagggaccgctatcatagcggagaattctcactgtgtatgagaatcatagtcttctgttgtggtaacgagggaatactatttccatctttggctgtggaatagctttccgtggctgctgctaagctcaggagagttagcaaatcatatgccttcattactatttggttctgtaacaggagtctttttttttaaatcattcatgacctaatctctaatattccctttaagggtttgattaaagttgagtacctttgaaaaaacactgacgtgattaaatatggtggacagaaatctatttacagtcaataagctaataaggcctggggtttcaagagatgtgaagcctgtgtgtatgtatatgtgtgtgtgtgcgcacatatgtgtgtgtgtgcacacatgtgtgttgaaagataaatagacaattttcagaattattttatgatgttgctattacaaacatattagctaactctggaaactggtctaaattgctgggacctaaataaaacatcttagaagacaattatggcattcaagtcagtaagacataatttgctttgttttcaattgttctatacagtcatcctgataacaatattccaaagctgttaagctcacattgcattctatgcaagccaataccactctacttgcacaatagtttcacattttcacacagaaaaataacattgtagaagtggcgacggcaaagtcattgtgccccagtgatgcccatgattaataaaaggtgacgtaggtgattaatcagaagttgtacatgttgccaaatttacagacttgtgggtttcagtatagatcactgtactttataaacctctcattcattcattcaataaacttttaaatgttcacaggcccattaagtactgggaatacaaaaaaacataatcctctactttcaccatgtaatcaacttaatattaccaataatggggattggtaagcaagtcagtgtcataatgtgcctcctgatatgatgcactggcaaggacatgatatcatcttgtggttcctgccaaacatgcttaacctcaatctaatcgtgaggaaacaatcagacaaatccaaatttgggggcaacatattaaacaattaaactcttttaaaatgtcaatgtcttgaaaggaaaaataagaaaaaaaggcagggaactgttggagggtagaaacatgataattaaatacagtgaatgatccctgattggatctttttttttttttaaatgtcattattaggacaacggagaagtttgaatatctagtctatattatatatgaataagtactttattatatgctatatattatatacttatgatattaagtatatattatatactaataaatattatatactaaaaagtaccagtgtagctttttttagtgtgataatgatataattatatgagaatatctttattcttaggagatacataataaggcattaagaggtaaaatgtcatgcctaaagcttacttttaaatggttctgttggccggaacagtgcctagggcactgttctcagctctgctggtctaagctctgaccaggttgcttctcagaattcttgtttggggcagtggctcacacctgtagtcccagcactttgggagcctgaggcaggccattcacctgaggtcaggagttcaagaccagcctggccagcatggtgaaatcccatctctactaaaaatacaaaaaattagccaggtgttgtgcctgtaatcccagctactcaggaggctgagacaggagaatcgcttgaacctgggaggcagaggttgcagtgagctaatatcgtgccattgcactccagctggggcaacaaagtgagactctgtctcaaataaaaataaaaataaaagtaaatgctttagtaaaaaagagattatatatggctatagtaatagctatattaacatatcttttatatttcacattatacatacattttctattaatgtctatatgagcatctatattgtgtgtctattatatctcactacatatggctatactattagtttcctagggctaccagaacacattctcacaaaccaggtagctaaaaacaaaagaagttattctctcacagttctggaggcttgaagtctgaaatcagggtggtggcagggccatgctccctgcaaagcctgtaggagaggaacttccccagtgtcctccagcttctggtagttgccagcactccttgtcattcctcggcttgtagttgcatcacttcaagctttgcctccatcttcatgggacattctctctgtgtgtctctgtctaaacttctttctttttataaggaccccacttactggattaaggcccatccgagttctatgtgacctcatcttaacttgattgtatctgcaaagacccaatttccaagtaaggctgtattcccaggtactgagtagacctgaatttgggggacactgttcaacccagtaaggtatataaagatattacagagggagagggagggtgtataggatgggagcatgtacaatgtagcaaaatattaatagatgatggattttggtgaaaggtaggtgactgttcattttgcccttctttcaatgattctaaagtttgaaatatttccaaataaaattaaaatttggggaaaatatactatatcaaaagaagacattgcctttgttcttcaggctatgtcgaagttatggaggacactggagcaaatgcctcatgatgatagcactgcagggccctgcaggaacagggaagacagcagacagtgccaactgtgcttgggaacattaggaagcgtttccatgagcagtgacagccggttgaacagagttttgaaggatagtgtcagagtcagcagcagggatgcaggtgcatctggggagctgccagttggccagaatagttggaacaaggggcgtgtgtgtgtgacaatggtggtgccgaggctggagagaggcaggaagcctgtcatccaggacgctgcaccatgaagactgggggagctgtggcagaactttaagcaaggtgtaacctgagcaaagttttgtgtgagggctggggctatgaagaagcctgaagacaaactaattggaagactggtgggacaagcggacaagccagaggagaaacaaggcaaagaagagtagaaagagagtgcaatagttagcaggaggtagagggtccgggcaaatgtttgtttttataagaagagagaaacgtaagcatctgtatatgccgaggaagaagagtcagcagatggggcagattgcagatccaggagagcagagatgatgaaggaagcaagtcctgggacatgggacccagaacacaatgggaaagagccctatttctactgggatgttgaggcaggggactggagagaggggaggcgtaggcctcagatcttctcaggacctcatgaagaacaagggagaggggaacagtgaccaggcaggggcagaaccgtggaagactgactggggtggacaggagaaaggaagagagtgagcccaaaggaggcgaaaacagggttactggtgagggaattgggaagcaaaatgatgagtcttggttcgaatgttatcgactcagggatcagtatcctgccttaattaacaaaacagggtttctccctgctgcatcctccaggcacacctggatggggcatgttaggtttcaccatcaacccttacaagggctgcttcaatagatttgtgcccaggattcccagaaaacaggtttccatgaatgccactgatacagagagttgggttagtgggtaccccttcaccctgcccccaagagctttttatgttagtttatgaaagggaaggacgtccgtcatgccattccatttaactgttaactatccaggggttacggtaacacacaaggctgatgagatgtgtaggctcaaaaacagagcaggccaaaggtaggcatgccaggacctagggctgaaatgatttcctctatcatgtggacataagtttccatttttctggaataaatgcccagaagagtgcaattgctagatcatatgttttgaaagaaactaccaaactatcttccagagtgtctataacattttacattcccaccagcaatgtatgagagatcaagtttctccatatcttgctagcatttggtatttgtattagtctgttcttatgctgctctaaagaactgcccaagactgggtaatttataaaggaaagaggtttaattgactcacagttccaaattgctggggaggcctcaggaaacttacagtcatggtggaaggcaaaggagaagcaggcaccttcttcacagggtgacaggacagagtgagtgcaagcaagggaaatgccagacacttataaaaccatcagatctcgtgagactcactcactgtcatgagaacatcatgggggaaaccacccccatgatctaattatctccacctggtcccacccttgacacatggggattatggggattacaattcaaaatgagattttgggtggggacacagccaaaccatatcagtattattactatttcttttaatcttagtgattctaacaggtatgtaatgacatctcaatgtggtgttaacatgcattgccctaatggctagtgatgctgaacatcatttcatgcacttatttaccatgatgtaacctctgcagttggatgtctcctcatgtttttgcccattttcaaattagattgtttttttcttaatgcaaagatttttaaagccttttagtaacattcttagaggcttttaaaaatcattcttccaagtacagaatatattttaattcagctctcagtagcagggtgttaactctaaacccatcattgcctcagcatggatgcaggatccaatcctctgttattcagcacgggcattttccccacatgtcacattcaaaaaacactgctacatcctcatctctttcccagccattacctgaactttacccctgagctagaatctccagagaagcttgaactttagcttctagagttgctcctgacctcatactttgctattgcaccactaagctgaaaccaagagttgaaaccaagctttgggaattatacctctttttctggatccacatgccctgtgatataaaaataaatgtcggccaggtgcggtggctcatgcctgtaatcccagcgttttgggaggccaaggcaggtggatcacctgaggtcaagattcaagaccagcctggccaagatggtgaaaccccatctctactaaaaatacaaaaattagctgggcgtggtggcaggtgcctgtaatcccagctactcgggaggctgaggcaggagaattgcttgaacctggcaggcagaggttgccatgagctgagatcgtgcactgcactccagcctgggcaacagaatgagactccatctcaaaagaaaaaaataaaaaataaatgtcagtgtgttcctttgtacttgttcccctgtgcgccagccagtttgtaatttgtctcctaacccaaaaggcaaagagtaaatgggaaagagtaggaacttgaaaatgtgactccctaaagacagtgggtcccctttgaacatcattaatttgcaggcataggaaggaaataaaagaatgtggaagagaacgtctacaggaggaagtcttgggtacactgtacaccacatgggacatagccttccctaacgtactgagagtctctggcaggttatttttaactgccacattgtcaagtaaatgtttgcactttgataagtgtcctgtccactggcttgttctaaactctggtctgggagcttaccagaagagcctaggagtggtatgcaagagagagagcctggatgagtgaaatataataattgtttagctgccagccctgatgtctatgacagatcaaacaatccacttgcattgtgtttcactgcttgcatcacctggtcatgagttttcagtggaatttgtggaatggattgttctcacggagtcacccaatatccctgaacaatggtagcatacattcttagttttatataagagctaataaggaatgttccagccacccgatcggaggcagagagctgttgctgatgcttgcctactttctttctttctttcacactctccctttctccttctcctgtctgaaggaagaaagaagggggcaggcagggaaggaaaaaagatccattatgtagaggtcactagaagagtgacaccacaggttggagggaagataaatatgaaatatggaaaataaggggtactctgtggtttttcccttcataaaatttgcttttatttatttattggttcttcctcagtgaataaccttctagaaaaaggcatcaggctgggcgcggtggctcatgcctgtaatcccagcactttgagaggccaaggcggccggattgcctgaggtcaggagtttgagaccagcctggccaacatggtgaaaccccgtctctactaaaaatacaaaaattagtttggcatagtggcgcatgcctgtaatcccagctactcgggaggctgaggtgggagaattgcttgaacccgggaggtagaggttgcagtaagccgagatcgtgccactgcactccagcctgtaacgtttcaggagtgctttttgttgcatgtaacagaaaactaactccaactgggtaaaacaaaaaaagagattgattaattaagcactgcaaaatttagaagtagtggtttcggtgttggtttgatttagtaacttgtcattttttctttaccttttatggtgtccatttcaaaggaaggctggctccatgcttcagggtttgtttccaaaaacaggcaagtccttttcacaactcgtggagacttgttcttaatactggatggatcgcccatgaccagccctgctggccagagaaatgtcacgtgcagattggctggggcttggctttcctgaaccaatccccacagctggtggtggaagggccctgttgatttagacgccaaggttcttcacaagggagggtgaatggatattggggcaacaactgcaatgcctactactacatcttcttaaaaagttattctaatttctgcactgatgattaaaatcctttaagagagcatcaagcctctcattctgaaacttgagataaaatggaaatagtaacagtgaattaatttacactgaaacatgttgcaggaataaatttttacaatcacatttgtcaagtgagccaagaagtaattttatttctctataattgaattagattaacttattatccccaatttctacttggtaatagaaaactatatctttctaattcaagataaatccaattacttcttgtttagaactcagtcaacttagtctttctttctttccttcttcttcttcttcttcttttttttttttttttgagacagggtcttcctatgtcctatgttgcccaggatgtacttgaactcttgggctcaagcaaatcatcctgcctcagcttcctaagtagcttgggactataggcttgctcatgctcagcaaaagccagtctttcttcagtaaattcttagtcaatataggacttctctcctttatctttctttctttcttttttttttttttgaggcagagttttactcttgttgcccaggctggagtgcaatggcacaatcctggctcactgcaacctctaccttctacctcccgggttcaagcgattctcctgcctcagtctccccagtagctgggattataggcatgtgccaccacgcctagctaatttttgtatttattagtagagatggggtttcaccatgttggccaggttcatcttgaactcctgacctcaggtgatccacccaccttggcctcccaaagtgctgggattacaggtgtgggccactgtgcccggtcttcctctccctattcttccaatcttcacttgaagaatgatcttggttcctgtggttcctacatatgatcttgacattaatgggtgggcaactgtgacgtcttccttgtgaggaggcctcctctgagatggctttggctttaggtatctatcctcactgccatctgccgctgatgttcacagtctaaacttgccccggtctatgcaaccataaggacattcccagtccattggatttctctcagccaaactattgttggagctcatggggaaggatgtcggggaaaccatgggaaaaattcagatgcccttctgtgctactaggatgtttctggaaacatggaggtggagatggtgggtctctcttagatagtttctctggctggacctgccctgtggccattgctactctactgtagtcacttatgttggcttagggctctccatgagaatatctttttgtaggattctttttttttttctgagacagagtctcgctctgttgcccaggctggagtgcagtggtgccatctcggctcactgcaagctccacctcccgagttcacaccgttctcttgcctcagcctcccgaatagctgggactacaggctcccgccaccacacccagctaattttttgtgtatatatatattttagtagacacggggtttcaccatgttagccaggatggtctcgatctcctgacctcgtgatccacctgcctcggcctcccaaagtgctggggttacaggcatgagccaccgagcccagcctgtaggatttttgatggagagtggaggcataggccctcctgctccaagatccccaaacccatctgaggtttctattacccctacgtacaggactggactttccaagagctaccccgacttattctcttgctctatttcccacttctcctgctttgcttccagtccagcgaagattttttaaaaatcgtcactgtctagtctggggaggggagcttatataattttgcattcttttgaatctcttagttatggcataaatcctgctatttagtagttttgttctagggctggactccagtcatgtgatttggagtgattttctcagctttagcaatacagaaattgaatagcatggtatgttcaagctttgcttcttattaattttgtttgtagaaatacactgggcacaatttgtgctgggggtcctgatctagttctcttgaagtgttcagtaatatgcggagatctactattcacttttcttcagagattctcatttttaacattgaaaagaaatggtcttgtctgaaaagcttttgcttgccacgcatatggaaacgcatttaggaataaatgactactgtttctgctgtttcggcaatgggttattgtgataacacagagattaacaacatgttggataaacattggtaaagcccagctgtatacttttagggcatggttttggaacttcatgttcatttctctttatctgtggggtatctgcttcatgaagtggtacctacaagtttagagcttgtagaacaaagccttgatcagctgctgtgatggccatgtcacagccacagcttcatttttcatcctccagggtcttgttaatctccttcagtgcttaaccgagagtaattccattgaaatgggttggagttcccttagaattaaaactcttatgtgtattggtctgctatctttagtctatttcattgcctttcctcttttctgagcagatattggatctaaggttctaggtgaagaagcaatgaacactcataagatgaaaagtataacttggaggaagaaaccccagggaaaggttttgtctccaggtaaatggacagatcacatgagatctttaattcccgtgcctgtacaagcttccataaatggaacatgtagcagagaggaccagattgacaagaagcactcagaagagaagcctgtgcctccatcctgtggctggctggggaccatcacacacgggaggctgtgtgctgaggaatgggtgtttggaggaatatcctcctaaccagcttttcagtggactcagatgtataaaaagaaaaagttgccaaggactgtacttgctttcccagattgtcctagggtacattgcattagcctaaaatggcaaccctctatcttcctagtgtaataataatagcagtgctgtttgcttggctctgtgatttctacccttaaaacccttgcactcagtgtacatatagcagaaacttcttacagtataaccagtaagattataggatttctattaatacattagtcaaatggtaaccctaaaagcactgaacattgaaaatacaatccaataggataacccagtaacgtgagcatttgtcctgtgtcccaacaccagcatcacaaagcgactcagccatagtcactctccaaataaaaaaatatataaattcatcctgtggagctgtgcgtgagaattttacaacattacacaaattgatggtgcccctcagtataaagagcacagtctttgtagacacagccttgggtttagcctcacactggtgactttcttaaccctggcaaggtaattaaccctatccaaaccagagctttccatctagtgcaccacgaagggtttacagatgtgctgagagactggtcctctcagttcttgaggaggtacttgctgtgatgtgaaaaagactagaaacatcatcatcatctcagtttcttcatctgtcagtcataattgtatttttctcatggggttgctataaggaataaatattgatctctgcaaggtgttcagcacagcacttagtaagtgattaccaaatgacagtatgtctagtctatacagtcctcagccaaccagtcactttggccagcatttggaaaatgtctgaaagataattaattccaaactattgcacaaagagaatcctgaaagtcgtgagcaaggccatcaaacaagtaattccactccagaaaagtcaggccatcctagatttaatataatgatggccattggaacaaattctagctttgcctgccaagttgctcttttttttttttttttatactttaagttccagggtacatgtgcacaacgtgcaggtttgttacatatgtatacatgtgccatgttggtgtgctgcacccattaactcgtcatttacattaggtatatctcctaatgctatccctcccccctccccccatcccatgacaggccctggtgtctgatgttccccttcctgtgaccaagtgttctcattgttcaattcccacctatgagtgagaacatgctgtgttttgttttttgtccctgcaatagtttgctgagaatgatggtttccagcttcatccatgtccctaaaaatatggaacgcttcacgaatttgcgtgtcatccttgcgtgggggccatgttatcttctctgtaacattccaattttagtatatgtgctgctgaagcgagcaccaagttgctctttaaggcatccttctttcacagtaagtagctagaaaagtatgaatgcttcggttccctattccactgaaaataaaatgatttcctcaaatttgagagctgttacaatttgtttccaatatacagtggtacccctgatccacaggggagacattccaagacccccattgggtgccagaaaccatggacagtaccgaatccaattgtcatcagttggaacacatttctgtttgtgcctttcacccaaaacttaatgccttttccatcttaactcaacacttatcacacactgtggccataacttttgcagttggaggtgtgatagcaaaactagcataaatttgtttttccatcttcccaatttcatggatagatttattcttactgtagattttagcaacctcagcgtacatttttttttctaaagtcaagaacttccacttttttacttcaccatactttatgtacggtttctctctggtgtatctgagagcatcaccaatgctctggtgattgccagcatcactactcctacactttagaaccattattaagtaaaataaggggtacttgaacacaagcactgtgatactgcaacagtcaatccgataactgtgacagctgctgactaatggacaggtggcgtctatagtgtggatacactggacaaagggaggattcacttccctgggcccagtggagttgcacagtgcaagatttcataattctactcagaacagtgcagaatttaaaactgatgcattgtttatttctggaattttccattgaatatttttggaccatggttgactgaggatgattaaaactacagaatgcaaaaccattaataagggggaatcagggcccagattattatttgtcctcatatagctgggtcttgatgagctatcattttattttgttttacctctgggtgccctgggcacagttccctattctgtgcctactctggggacacatatattaggatcagaggtggcaagactatctgtaaaaggaaattgaaaagacatttaaaaacctaaaggaagattagtgatttcccagagaaactcaatggcagatgtcactggaatcaagaaccattgctctcatgcctggaaaacctgtttccaaaatgttcccttttgctgccaagggatcagctgctccagtagctcagcatcttggcaattgtgggaagaggacagaggtgaagaatctctgggcttattagacatgaccttagagaacactgatgtgggaaagcagagaatgaacttacaatgagtgcaggatgtttgaaagcaatacactatgaaaatgtttcatattttaaaaactaagtaataagcatgtaaaacactaccttctctcctaaaccaaatcagctgtttggatgtaaaaaataataaccaaatagtaaatgcacttaattttttaaaaggagtttgctgggaagctattaatgaaatagaaattgaggaagtcttactcaagctgcgttttgtttttggaactgcagaacacactcccgtgtctcgagtagtgtctgagaacacagaaatgggaatctgaatactgggtttccaataactgctttgcaaatatttagctctatgaccctgggtaggacaaagacaatcttgatgcatcattccacacctgtaaaattattatttataaggttcaagagtctatggcatgaaattcagagactcgggggtccaataaagagattatgtatgaaaagacctggcccagtgcctggtatgcagtaggcatgccatgaggtagccttctggtgtgtgtgtaaagcacaaacccccaagatttcagggctgagtggagccttatgggttattccatattttctatttgtctttgtatgtttccattctgacccattgtgcatcgattttaaagattaaactctcataaaacaacctcatgttctgcatttctaagctattgggggcagatgggaccttcattgaaacccccaagtccaaacatatgtgtttaccatggtcacagcctactatgtggcggataaattgtctgtttagttgtctatgtcccttgaccaagaatttcttgacatacagggactcccactttttgagctccgtagcacatctgatgcaaagcagttgctcgatatatatttattgttgtcattgaccattaaacatacaaaaaaagtagtctgattgaattgaatttagacgtacgtgaagaaataataagttaccagaagagtggtgtcctggttgaaatgggacacataagggcaagcacttgccattgtcacccagcccttcagggtaagcagcatccttagcccacagtttctcatcatgatcacaagagaaatgcaatctctgatgggtactctacccattgtcctgggcctacctatccacagatctattcctgcacctttcccagaaggctaacccctgcaggctatactcagtctccctagtcaactgacttcaaaaaggagaaattggcacttaacatgacacaagctctgctgtcctctttttgacttcctcttaaggaccatggaaaagatttactccccagatccatttttgcatgataattaaagggcccttgtagcaaatggactaagagcttcccaggtccagctcaataccccttccttccaaaagatcatcctattcctgcctggcctcagtggttactctctggtctgaacacacatagcacttccagtttctaattcatgtttaatacttgaaatctactaccttgcattgctatttatcttttttgtaggcctttccttttcaactagactataagagagtagactccattaactacatgttttgtatccgctaggcctagcacacagtaggtactgaaaataccagttttttataatggtactgatgaagaaaagtaccattcccactggatgttgttagccattgggagggctgtgcctaatggactttgaagttcacctgagcctgaattctgattcttcccccatatttgatatttaacttggggcaaattatttccattcctctttgaaaatgggagcaattctctcttaggattatttggataaaatttattaactttagactgattagcaccagggaaacaatcccaactggaagttatggtgatcttgatgacaataataatacttaaggggctgctgcataatatcctgaccaacatttcatcccaaatttccactgtaggaagtagaaaccagatgtgcccaaacattttaaaacagctattttattgaagtaatttcatgtttatggaaaaccagcctgcaatagaaatcagcccctcacttatggttcacggtcacttgatgaatggcccatcatcataaaataagcagggagtttggctgggagccatgccacaaccattttattggaatgactttgttgtcactgcatccccacactcatctctctcctacagcacagttttgagtgattgaagttagtttgggcaagaattccagacagggaaaagcaaataagtgtgtcaggaggtcaaaagagaagaataagccacaggcggaggaagaaatgcggagctgataattgaaagataatggatgtaggggtgggttacagcaacacagtgggagggggatccagacccagcgctttctcaggcatctgagcgagacccagggttacaactcatcttacaagatctatgaagcatggatttcaaaatatttgggccacccagtatggaatttgggcaaatggcactattgaataaagccattgacaaattactttcctttcatttccttcactggcaggatcttctgtttatgcctcctgagatgcaaaactggaaggagtaaatttgctgacaagtatccatgtgcagggacagttgatggaatttttatcatgcaaaaatagtcttggatgatgggttgagagattgccaggaatctctggaatctaaccctcagctgagcatatagaggtttcattttaaggtggtatcaaggtgaagaacttataaaactaagctgtattgattttttttctttgcaaatgtttgaattttgtaataggcattcattcccagcgaaatcttaactaaataggaggctggaaatctgtgacgtagtggaccaaggttaggttttaaaggtaggactttttaatcagacagctgactctagaggtttatacaagatcataactttaatccctccatgcccctgttgtcttatctgtaaaataaatataataatcatcatcccaaaggttataagaattaaagcaaattataaaggaagtagcccctggccttaggagaccctcaaagtttaaatgtcctttttcttttcacttctctctcttattttaactccttcctatccagctccagcaattttctctgattttctgtgtatctgatggaaacagcctttgctgaacttataaataatgcaggcaaggctgggcgtgatggctcacacctgtaatcccagcactttgggaggctgaggtgggcagatcacctgaggtcaggagtttgagaccagcctggcaaacatggtgaaaccccatctgtactaaaaatacaaaaattacccaggtgtggtggcaggagcctgtaatcccagctactcgggaggctgaggcaggagaatcacttgaacccgagagccagaagttgcagtgagccgagatcgcaccactgtactccagcctgggtgacagagcgagactccatctcaaaaataataataataatgcaagcaacatgaaagagaaaaggaagtgagccatgtagctactgagagggaggtatttcaaagaaagagctcatcaagtgcaaagaccacacagtagatgtgtacatggacatttcagaaaatctcaaggaagccagggtggctgaagtagaccaatcccaaggaagtatggtaggagaagaggtctaggagatccagaggggcagagtgtatgattgcctagggccttgaaggccagtaaaagtacttgagcttttactctaagtgggttggggagctgctagatggttctaaactgaggagtgatgtgttttgaaatgattctcctgactgctatgttgagaatatgttatagggcaaggatgtggaatgaggaggagagggacacataggcagaacagggacaccagttaggatcccactaaataacccaggcaggaggtcagagtaggtcagtagcagtgtaggtcatgagaagtcattagaaaaggtagagcaatttaggctttgctgatgggttcaatatataatgtgagagagatccctttaagatttttggtgtttatgaaggtgctttttagtgtaggtagttgttaaattggtgccctcacagggggcattgggggatgatgggtggagccttctattctgccgccttgctccaccccaagtcagtagtgtttttttagggcatgataaattgaatattctaaaggtgattatggtgatggttctacaactctgtgaatatactaaaaaccatttaattgtacattttatcttattttatttttgagacggagtctccctctgttgcccaggctggagtgcagtggcatgatctctgctcactgcaacctctgcctcctagattcaagcaattttcctgcctcagcctcctgagtagttgggattacaggcatgcaccaccactcccagctaattttcatatttttagtagagccagggtttcaccaggctggtctcgaactcttgacctcaggtgatctgcccgcctgagcctcccaaagtgctgggattacaggcgtgagccactgcaaccagcctgaattgtacattttaaaaggggaaactttatggtatgtaaattacatctcaataaagctgttggaaaaaaagaaaaggaggaggtggtcagagactgagatgcttaaaattgagattagggaagatttccacattggcaataacaagagctagagtctgaccatggaagttgagtagccaagatggcttggaggaggagtcaaggaagacagaggcccaagtactggaaggacatctgtgaggatatgggtgtcactaagaatggtggcaaaagtcatgttggtgagaggtctgacagtgagctggggggaaaatcttcaccaagtcaggagtgacctgagagtttgcagatgactacaacaaggaagcatggcaggtaggaatctgatagcaggatgttccaactgggtgtgggtagaaaaaatgttctgaaatttgaatattggtgaaggacttaaaaaaaacttcaagtattaagggcctactctacttttcctttattaattaattcattcatgcaacatgtatttgttcttttggggacaccattatctactcatttggccatatctgcagatgctcccaaacatggtggagctggcttttgatggccagaatcccagattctgttataataatctcctttcaatgagttccccaaggacctattacccactagtatagtggagggctgttctgatcagtatgcagcctttccttgatcactgtcatcatattggccatcattgtttagttacactaatatagtatatggctttatgtttcttaggctgtagggagctgcctgttttagaattagatggaagaagttgtgataagctttgcctttggacagatctgggtttaaatcttagctctgctatttataacttcataacttcgggaaacttaatattgctgagtcttagtttcttatctacaaaatatttacctcataaatattggtgagaattaaataacatgtgtgtgtcaaactccaaacagatagtaggcacaaccagagatgttagttctctttcctttcccttgttttccttccttcacctttatgttaatgttgcttctgctattttatttctagcttctatcatgtccagggtctgggttctgatcagaagccttcctctagggatggttgaaattatcaagccaacttccagattggcatagagtcactctgattgtttactttagtgtgccatgttatgcttctcaaggtgttttataaaatgtttctaatcttactctttaatactgtgaggtatataagtgaggcattagtattcctaatttatggaagagaatataagatactgaaagtagctaacatttattgggcatttattaaatatcatttttctaaatgttttacatccattaactaacttaatcctcgcagcaattctatgaaataggtattattaactttatctcacaggaagggaaacaggcacagagaggtcaaataatgtgttgaaggtcacataacttctaagcatgggggccagatttgaacccaggcagtctggttacaaaacttaaccaatatatggcctctaatgtaagacaagtaaacaaattgtgtgggggttgcaagtgaagaaatccttttaccagttactgctcaggtatctttctggcctctgagatggagtttcgctctttcacccaggctggagtgcagtggttcaatctcagctcactgcaacttccatcttccgggttcaagccattcttctgcctcagccttccaagtagctggtattacaggggtgcggcaccatgcccggctaattttcgtatttttagctgagacagggtttcgccatgttggcctggctggtcttgaactcctgacctgaggtgatccacccacttcagactcccaaaatgctgggattacaggcgtgagccacagcacccggcctggcctctggaatctgatggagatggaaaatgttggtagctcactgtggtcactaatagaacactattgttatcttcagcaggagggaggcattccatacctcctgcatgagttttattaccctgtttccttctagctcagccacccttgagaattcttttgctgagacaaacaagacaatccctctgagatagtagcaataattgccacccttgtcctattttagttctgcttgttgcaagccaagttctaatattaaagccagtactaaaaaatcataaactttctcaatatcataagtctaaacacgtaggggaagctttggaaaactttaggaaacaaataattcatgaggtcaaaatcaatctcataatgaacaagtagatttttttctttggaagcggaagaatatctggcctaagatcgaaccattggacactcatgaaacttatcttagaacagtgaaactatctagtcagtcacattgtggattatttactaagtgctagaaatctcatagttaaagcatttcatcaggagtagatgatcaaatatttaaaatatcaagagatttgttatttttcttcttgctggcactgatttagtttctaaccactagaatttctcccagaccaggagtagggaaaaaaagagaagagaaaactaaagcctaactattttagtatgttaataactttgatatgaatctgatgaagaaagagttgaaaattattagctaaaatgagatagggcatgtgtgtgcctatatgtatatttaactattgccctgtgagccctattctatttgaattggcaataaaaagtggacttaccttatatacttgtaaaatgcatgaaatacatatacaatttgttgacttatttattttctaaagactcagtctctccactgatgtagttactgaaaagaagttctcttttccttatttgtaaaacgttttacatatacatcccctatatgtacgttataatagatgttctacacagatatgcatattgcatatacatattatgtttccatgaataaatacagcagaatttcagtctaaggaatgaaaagattatgacttaaacataaaccaactggagcaattcaaagggtctttcttaagaacatggaataaacgtgctaagatggctgaaattatttaaagaattaggtaaaatatacataaattcctttaaatttaaagaaaatttttaaaattaaataaaatataaatgaatgcctcagtctttgatctgaatgcagcagaaaaaggggattgaggcatggctgggggccagctagccttggcctcttgctctctgaatggccctggtccatcccctctttgaagctgagtagagttcactgggctgaggcatacaataacggcaggggcttggggaattcataagagggaaaaaagtcgcactgcactttctgagaaggccgggattcacatatgtgggcgcacacacacacacacacacacacaccaggaaatggagagtattgcccttgtcacagaataggcattcttatggcccctccacacatttcaagagactttgagaaactagtttggggctggaactgtctcccatgccctttctaagatctgagagcccagtgcccaatttaggagagttcaaacaccaggaacacaaaagactcaatttggagtgcagcggcctcttgtctgtcaatcctgtttgctgaacctgctcctccttcagggtactaaaacgggatggagcagaggaaggactgggatcaaggataggagtcctctatgatggtgctcattctccctccataaggagcagatgttacttctcttgaggatgtgttatttcatttcctacctccccctacaaacaattgtgatgaggaggaggaggaggaggatggtgataaaggccaacagcatttattgatccctgactgttgggtattatgctaagctttacattcatcaccacagtctactttcattccctcaataatccccagcagtaggtgccaatatcctcaccatagtctactttcattctctcaatattccccagcagtaggtgccattatcctcaccttccctgtttctctggaaaataaactgaggcttagaggaaagaattaacttgcttaaggtcacacagctagtaagtggttatggtaggtagaataatctccagagatgtccacctcctagtccatgtgactatgttgtgttacgtgccatgggaaataaaggttgcagatggaattaaggttgttaatcagctgacctctagattggggagattctcctagattatcttattgggccaaatataatcacaaagatcctcataaatgaaagaagcaggagagtcagtgtcaaaatggcacagagtgagagagacttgatggccattgctggctttgaagatgaaagaagccgtaagttaggtctgtggaaggctctggaagctagaaaaggaaaggaaaccaattctaccctggaatctccagaaaagaacacagctagctgacaccttggttttaggctagtgagtcccattttggacttctgacctccagaactgtaaaatactaaatttgtgttgctttaagccggtaggtttgcagtgatttgttacagcaaccagaggaaactaatacagtggtaaagctgaagcctgaagtctggccctagaccttctggtacagagctgtgccttgctccttatagtgcaggccttggtagaaaggaatagaccactctgctgaacagctccaccagacaggcccaaaggcctaagagacacaaaacagatcatgaacactccaggaatggcagacattctgtccccatccagccagggaatggtggggtggggtgagcaagttctcttcaaaacgctgaatccctgggaccatggcatttccccactgatcacattcattctgtctggtccttcaaggaggtaacagactagtggggggcacagtcaaggtaaacagataagtacctttccatgggatagtgctatgatagagtttatggaaaagcatagaagaggcatgctaccagtttcaggggcttcaggagggctccctagggaaggtgatcactgaactgagtcttgaaaggtgagttagggggttgtgaggctgagggtggtagaggaggaagctgcacctggaaagtcctggaggtatatgagagtgtggaaagtcctggaggtatacgagcgtgtggcttacccaaaagctgcacatggatttgacaggactaattgagtttttatttgtttgtttcatcctatcactggtaagacaatatttgtatcagtcagaagataccaggttaggctacagtaacaaacaaccccaaatctcgtggcttaaaccacaggtttatttcatgctcattctacatgtccatgatgtgtctgcagggcagcagctcgttttagtttcccagtgaccctagcttacagagtggtcatcatctcaaacattatcagtcaccatgccagagggaaaggaaactctgaaggatctctgcctggagatgacacgtgttttttctgctcaaaatatgctgacaagaaatgtttcatggctctacccaactgcaagtggcccagcctagaactcaatgaaaaaaagcatttcctctgaagccaaggtggagagccaggaatacttgttgaacagaattaatgaccagcactgtgtttgttagccattttgtgtgtgacactgttcaaccaaacaccaagcaatttagaaagactggtatttaccttcttagacttcttattagccactagtgccctaagtcttctctaatcgtggatttcaataccattatcctcactgttccacaacaacttcctgtttttatattatgcacccatgacttttctaagaaagcatgtttctagtttgcttttgccatcaagaatcttagagccaaatttgcactatagtacgttccaggtagcccttattatctgcaaacagttggtaccagaaaaagtctgtctaagggaatccattgtaaaacagggagcaaaatatgatgttagattatgcagagttgaaaaacaaaacaaatgagtatgaaaataaatttacttaattttacttttaaaacacttatatcacattgcaaccacgtgctaattctcagcatgaaaaattaaccatgttgactttttgggtcccactttcctcaaaaaattttaagatagctcaatggctttttttttttttttttttttttttttgatgcagagtctcactctgtggcccaggctggggtatagtggcacaatctcggctcactgcagcctctagctcccaggttcaagtgatcctcctgcctcagcctcctggcttttttttgttttgttttgtttttgtatttttagtaaagatagggtttcgccatgttggccagtctggtgttgaacttctggcctaaagtgatctgcccacctcagcctcccaaagtgctgggattacaggcgtgagccactgcacctggctggtttattctttatatattgcctcttttgagagatattctagttaactatgcaatggatttgcattctatttgctagttgtattggttgtttgcaatcccacagcatagacgttgatggaacagcaggaaattggagctggtgctaaactgcagaatctgttagagcggggccttcttttacagctggtctcttcactagtgaatatttctgaattaggaagactttgcctccctatgaaaccctgtaactgtggagacctggataataaatacctagatagagaatgagaatccccatgtgtggaatgcatttcttggaattaatcttgtccttggcttttattttatcacttttttcctttttgttcagattccctctactattttctttttttcttttttttttctttttttgtatttttaaggagttgcctcagatcttttctaacaggaggcagggtataaaccaacaatggacataaatattgactacccaactttttaattatccccaaacttgttttttcagaatcggccaccttggggtagatggggtctgtgaacttttcttaaggcactgagcggagttgagtggctgaagatgcttcagtgaagcttgatgtttatcctacccttgtggtcagctccttcctcccagggagctgtaaatcaagaactgtgggtgtttcttgattttccggtgctgcagctcatttggatggtccatagggtgtcactgggtaacttcctgctctgggacctctctctgaaatagaaacttccctccaaaggagagactgtctcctatttcatttataaatcaagttaactctggttctttgactttaagaaaataacctatctcctcctctcagcaaatttcttcctcttggtctcatgcatgcagttgctaacacatgtattcttgtggtggaaacagtagaaaagtattaaacctttaaaataaaaccacaaaaccctgcaattcatgaaacaaacctctatggagtctttgctctttgtaagggactttccgtgtgtttgttcatgcaatccttacaccaaccctatgtggttagtcttattgttcccatattaggtgtaggagatggatgctcgaagaaggtgcaaatttcgcccaagatcacctagtattggaagtgggatttatacctatgttggtctgactgcagagctgcccatctttatacacctcaccactgtctcacctcttttcttatgcttcccagccaggttataaaacttggaaaagaatagcatacctcctatctagaaaataacaaaagaaagtcattctgtaatttctaaataatactaagtgttacatatgtattttaatttaaataaaactatggaattttccctgatggtcatcttaagtgtgagaaacacacattttcacttgtcagggtggtcttatagtaatgcagagcaaacaacattatctatattttatagatgagagacccatccagggtcctgcagataaaagggccagagttgggattagagcacaggattcctgactcctaacccagtttactttcttctactacaatataccccatttacgaccccaaataggaatgttcaacagtataaatgtaatgatttaggatgagatgagaggtagatgggaagaacaggaggaatcacctctgtaccctgtggcactcattgcaacccatggaaatgtttctgttttaaagtccagcatttagttctggtgccaaaacaatgctgagtaatttcgtagaacctgagaaccagagaaggatcctgggaggaactttttgtttatttgactttatttcattggcctcactttatgttcttttcaaaaccaagaatgcccactgggttgtgagtaatgacaatttccagacaatagaaaataatgcccaaacggctttgtttgagagattcttgacgtcttttgttatccacctacctttttatctctacattttgctcattgcttccatacaattatcgcacttatagagagcatatttttcctcaaaccgccaacttcacaaaacagcaaatgatttgtaggttatgttgcattaactgtgagtgactgaagtgcccctcaatcacatacccctgcctttatcttcatctaggaatgaaagtagccaggaaaggcaaagaaatcattcaagaatttaaacataaaaagttggctaaattctgctgtggtagacttctaccggatgagtttaatgttaattaaaactccaagtggagttgtttgtaaatgaatcattccctgttcagtttgatgtagcaaggtcagcttcctgctccaccggcagtgcgtgccagctctttttctcatgtgtaagctgtgaatgctgttaagcctgtaaaccactataataggttcagagattttaggatccctgaaagagaaggatcagaacacagcagtgttgagtgtcaggtttcttgggcacttgaaggattaggcaggacaagtgaagtgttactttagggacaaatgtctgggcgattctcaggcagcaggctggagaatgtgggctctgaggttagtcttgaattctaatcccagctctattgttttactgactgtgcaacatggagcaagtcattgccttcttctgagccttggtattctcatttctataaaaatacaattataataaccttattgtgttgttgtgacaatttgatgcgataaagttactggaacacacgaagccctcaacatctggttgcaatcatgatgataattaatgtatctatgcaataaatagtgggcactgctatgtgctccatgctgttctgggcgtcggggatacagcagtaaacaagacagacacaaatccctgccttcgtggggctgacattccagtagaggacagacaataagcaagatacgtaagtaaaaaatagagttcatggccaggcgcggcggctcatgcctgtaatccttgcactttgggaggctgaggtgggtggatcacttgaggtcagaagttcgagatcagcctggccaacatggtgaaaccttgtctctactaaagatacaaaaattaactggatgtggtagcgtgcgcctatagtcccagctactcgagacactgaggcaggagaatcacttgaacccaggaagcagaggttgcagtgagccgagattgcatcactgcactccagcctgggtgacagtgcaaggccctgtctcaaaacacacacacacacacacacacacacacgtcatgaattaagtgttaatgagaaaataacaatgcggaggaagataagtagtattaggggaggctgaaattttaaagcggtagctaggaaaggccccctctggaagacgaatttgtgtaagacctggaggaggtaagggaaaaagtcaaatggttccctgggggaaaagcattccaggctgagggaacagcaagtctaaggcccctgaaggaagacagtgcctgccatgctccctgtgccgctggaaggccaggggctggtattgagtgatccagtggagaacactaagaagtgaagcagcagggaggtcaaatccagcacggcagggcctttggtacagagggaggactgcggtttctcttctaagtgtgatgaggagggtcacagggagggcacaaaccctggagaagcacaacacaggaccaatccccataacagcagctccaccctttctcacttagactgggctagagtggttaagcatgaggaaaagagatgggcctggctttctgtgcctcaaagcaccacgtcaagctgtgacataggcatccaccactcttcctttgtgcctacacctgtatttttgaatgtactctcatcacagtgtatatcaccgtgctgttcttcaaagtcagtttccccagtatttgttcaataaatgtttaccgatcactcattacgtgcaggcactatgttaggtgctaaatagtacagtgacataaaaggctgtaaacaattaaaaaatcaacgcctcttatgtcagaaaagtaacactgtgtcatcaaagcaaagtcgacttctcctataggtgtgggtatatttaggatttgagaagggaaaaagcgtgcttagcttccgggctccaatgtgcggatatacaccctctccttagcttgttagcttagggatttcccacccagttgcacacggtgtgttatctgaagtcatttaacctgttgacagtcgcattcttggaataagtaagttccatgcaggtgaacttggacaaacaatgccagtaacctttttagctgctgaagtaattggtccaaaagtttaaaataataagcttcattttccactgaatcttgttgacagagagtatcagcagggcttggagttagaagagtctaaatccctgatgaatagttcaaaaaaattactgttaaactttttgtaaacaaggtttttttagtcataataatgtttttaagataaattgtgtggataattggtacaaacttacgatgtatgcatttagttagcctcagtacaatcaaatgtgttgttaccagtgcatcaacaaatgcacctcaatatcttaatttatcattcatgataataaatggagacaacaccatagattaaggtaattcacagccttgttctagccaatggcttcaactttctttcctttttttttttgagatggcgtctcgctctgttgcccgggctggagtgcagtggagcgatcttggctcactgcaacctgtgcctcctgggttcaaatgattcttctacctcagcctcctgagtagctaggattacaggtgcgtgccaccatgcccgcctaatttttgtaattttagtagagacggggtttcaccatgttggtcaggctggtctcgaactcctgaccttgtgatctgcctgccttggcctcccaaagtgctgggattataggtgtgagccactgcgcccggcagtggcttcaactttcttggcaaccaagtttattgtaggagtggccaacaaatatcacatccacagacactgatgctaccaaatagaaaggtcaggaaagggccagcagcaacaaagagggaggaggggaatgtgagggtcctaaggaatccacaggctgatggagcatcccttaatccagttaactgaaatgagttagactaagagtctacacttggcccccagctggctcaattcaagtcctcccttggacctactgggactccacctttaggagtggatcctctggaggaatcctggcaccaagcaaacttcccagggctcctttgacttgctggaaattggctgacctctgagggagtgttgtttaaatggatcaatttaagcacagaaagaatccagcctaattttttgtgtgtgcgttttaatttttttttatcagtataggctctctgacatgtcccagtgaatgtgcatgttttttaagtacaatgatatgaaatatattaaaagtatactagaatataaactctgggaaaggagagaacaccgtgtttcctttgttgatattttcccagccctagaattatgcctgccaatgatagatgcttaaaaaatacttgtgagatgaatgaaagaatgaatgtgttcaccaagtttctgacctcaaagagtttaggacctagaagagcagatagggcatggtcagaaatacctatgacaaaggtagtgactgaggcttgtcttaagacagaaaccattaagaggagaggatgaaatagattctgcctgggttgataaggagacatttcataatggaagagtatttggaggaaaaaaggaggaaaaggaaactagaaatgtgggatgggccttctacaaaagatcactgttgaagaaagcttctaaaaatcttctttggtaataattaaaaccccaagacagcacaaatccctgagagacagtatggagagatgtgagaatcaaaacatgaagtaggggcccatgaaatgtttgacaaataagtgccatttcaaaaacgtcatcccatggccaggtgcagtggctttcatctgtaatcccagaactttgggaggctgaagcgggaggcttgcttgagttcaggagttcaagaccagcctaggcaacatagtgagacctgtctccacaaaaaataaaaaaatttccccaggcatggtggcacatgcctgtgatcccagctactgaggaggctgaggtgggaggattgcttgggtccaggagtttgaggctacagtgagttgagatcacaccactgcactccagcttgagcagcagagagagaaccctcacttgggggctaggatgaattttttttcgagacagggtctccctctgttgcccagactggaatgaaatggtgcaatcttggctcactgcaacctcaacctcctgggcccaagcgatcctcccacctcagcctcctgcatagctgagaccacaggcatgtgccaccacatccggctaattctaaaagtgcagtgcaaaacgaagagattgtgaggaactctgtaaatacaaaaggttaaagaaatagtttataagaacagtgaacaacaatgaaactctttatgacagtcttccccataatgtttgctttcacatcaaatcagtcatgaggacatgatataaactatacaaatgagctttcttgacttccttttttaatataagaaattgattgtttcctaggtctcatttcgttgaaattgttggcaaataatactgaagggatgcaatttcacaaactgcaacatgagcaagaccgtatctacagtgttcatcactgtactcgcagcttttagcaccatagctgaccacagtagtggctgttcataaatatttattgaatgaacgaaccaatattttctgagtaggtcctgtgtgcaaagctctggagaggcatgctgggggaggaaaggatggagtcatgatttctcatgaagtctcttcaataacttcacagtccaaggtggggaggggtgggactgtgagtggggaacagacatagacataaatagctttgctgaaattcagggtgtgtaaccacagcagcaagttcaagcagtataaaaataataaactattagatgtcactttacatttatatattattttgtccacttgattatctgaaaatgggaaaaagaagaattattattattatttttttttgagacagagtctcgctctgtcacccaggctggagtgcagtggtgcgatctcggctcactgcaagctctgcctcctgggttcacgccattctcctgcctcagcctcccgagtagctgggactacaggcgcccgccatcacgcccggctaattttttgtatctttagtagagacggggtttcaccgtgttagccaggatggactcgatctcctgaccttgtgatccgcccgcctcggcccccctaaattgctgggattacaggcatgagccactgcgcctggcctaaatttttaattgttatttataaaataaaagctattttatatatattaaaatagtatatattggccaggcacagtggctcatgcctgtaatctcaccactttgggaggccaaagtgggaggatcacttgagcccaggagttcaagaccagcccaggcaacacagcaaaagcccatctctacaaaaaatacaaaaattagccagacctgttggcacacgcctatagtcctagctactcaaaaggctgagatgggagaattgcttgaacccaggaggctgaggttgcagtgagccaagactgtgccactgcactccagcctgtgcaccagagcaagagtctgtctcccaaaatatctatatatgtatatagatatatcaattatataatatatgtatatagacataccaagcaattatatatgtatatacatatatctatatacatatacattcctcattatgtttgctatatacatatacatatatatagatatctatatatgtatgtagctatgtctgcatataatttgtatatgtaatatatgtatatatataattgcttggtctattttatgtatcttgagacctattgaaggtttttgaacatgtgggcaattctggagagtaattactaaaaaaagagaaaatatgggtgaggttttgtttactcaggttttgtttttgttttcccctttacttccctttcattgttattgacgtctataagtatccattggcatgtgacccagatcgagccttattttcctgtttccaaagcatatgattaatttctaacgtactacattacttacttgtttattatgtttattgtttgcttcccctcctctgcccattaacttaagcatcagaagatcaaaaggtttttgtctattttgtccacttttatagcccaagcacttggaaaaatttctgatgtaaagcaggtgttgaataactttgttgactgaataatagtgcaggacatttttgttttgttttgttttgttttgagacagagtctcgctctgtcgcctaggctggactggagtggagagcagtgatgcaatctcggcccactgcacctccacctcctggtttcttttcttttctcttttatttatttattttttttgagacggggtctcgctctatcacccaggctgaagtgcagtggcatgatctctgctcactgcaacctccacctcccaggttcaaatgatttccctgcctcagcttcccgagtagctgggattacaggcatgcaccaccacactcagctaatttttgtgtttttagtagagacggggtttcaccatgttggccaggctggtctcgaactcctgacctcaggtgatccacccaccccggcctcccaaagtgctaggattacaggcatgagacaccgcacgaggcccacctcgtggtttcaagcgattctcccacttcagcctcccaactagctgggattacaggtgtgtgccaccacacccgtctaatttttgtatttttagtagagacagggtttcaccacattgcgcagggtggtcttggactcctgagctcaggcaatccaaatccacctgcctcagcctcccaaagtgctgggattacaggcgtgagccactgtgcccagccagcgtatttattttttaagagcaatattaggttcataaaaaaaagacgaatggaaggtgcagatatttcccatgtatctgctgcccacacatacacatagcctcccccactatcaaaatcctgcaccagagtgatacatttattacaactgatgaacctacatggacatctcctgtcacccatagtttatagtaggttcactcttggtgctgtacattctatgggttttgacaaatgtacaaggcatgtgtccaccactacaatatcatatcgaatggtttcactgccctaaaatattctgtgccaccatattcatcctacccttccctttaacctcagccactgctgatctttttactgcctccctagttttgcctttcctacaatgtcatacacttgaaattgtgtggtatgtagccttttcagactggcttctttcacttagaaatatgcattttaagtttccttcatgttgtttcatggtttgatagctcatttcttttcagtgctgaataatattccattgtctgaatgtactactttatgtatccaatgaattataattttagaacaaaaagtaaggtaagaggaacacaacttttttttgttgttttttgtttgtgttttttttttttttttttgagacggagtctcactctgtcacccaggctggagtgcagtggcgtgatctcagctcactgcaagcgtcggctcttgggttcatgccattttcctgcctcagcctcctgagtagctgggactacaggtgcctgccaccatgcctggctaatttttttgtatttttagtagagatggggtttcaccgtgttagccaggatggtctcgatcttctgaccctgtgatctgccagccttagcttcccaaagtgctgggattacaggcatgagccaccgtacccggccagaggaactcaacttctaatgtaacccgtccccaacccccaggccacggaccattacagtggtctgttagcaaccaggccgcacagtaggagtggatgagtaagtgaagcttcatttgtatttacagctgctccccattgctcacataaccacccgagctctgcctcctgtaagatcagtggcagcattagattctcacaggagcccgaaccctattgtgaactacacatgcgagggatctaggtagcacactccttatgagaatctaatgcctgaagatctgtcactatctctcatcgcccccagtgggaccatctagttgcgggaaacaagctcagggctccgctgattctatgttatgctgagttgtataattatttcattatatgttataatgaaaaaataataaagtgcacaataaatgcaacgcacttgaaccacgccaaaaccatccgcccacaccccatccgtggaaaaattgtcttccacaaaactggtccctggtgccaaaaagtttggggactgctcttctaaagggataaaacagttgccctgagtggactttttgaagatgtaaagcaagggctggggagatgtcctgagcaccgtgggataatggcctttggatggaaactgagttctgtcgttcattcagctgatgtttaagggcgccctccctgggcaggcagggtgctggttcttgagggtgtggacacccagagccagtccctgcgctctcacagttttccctctggctgcaagcgctggggtgtggccctagctggtccgttgggctctgcaggagtctaagctgggctcgggatagccggacagaccccaggccaggggaaagctcactcgtggctgtcgcatctctccctccaagcaggtcgaagaagggggcaaagcagacaccctgagctccaaactgcaggctggggatgaggttgtgcacatcaatgaggtgactctgagcagctccagaaaggaggcagtttccctggtgaaaggatcctacaagaccctcaggctggtagtgcgcaggtaggtggcagacccccaccctgtccctcctaccacctcaccccacctctctccctaccctaccccacctctgggaaaagagctcggggttggtagcttggctttaaacctccatgtatggatcctgcctttttttcttttttctttcctatcttgtgggatgtggggaggaagtggggtgaagacatttcagacactgctgtctttcagaacactcatttcccagcaggtactggtttgtcagggatagacctcactggactacctaaattttgggacctgatgaaaagtgacactcatcccagatgcggtcagagctctaataagctttttgtctggtgggactagagaaagaaattggcttggagctttcagtggcattttgggaaccacacctgcatcacagggttcttcaaaacaggcaaattctctcattggttgttttgttttctggtctcaatagtggtgattcctctgttgggaaagtgttgggttgtgtttgattttaatgccttagcatcagaagctttgtactcccgggaaccaacccttcgtggaggaaattatttatggaaaggggatgggaattgaattatttttttgatctctattagtaagcactgcttgagacattttacacatcttagctcatttaatctgcacatgaaccccatgagatagctaatcactatccccattttacaggcaagagattaaataggttactggaggtagccaagctgataagttgaaaagccagaatagaatccagattgcctgattctatttcatgccacttgagcatcattatcttgacctgctaagcgctaggcccaaatattttgcatatttgaatatttcttccttagatttcagctgcctcacatagcagctaatgttacagtatttaagaatgttctagttggctgagacttcaggagtcatcaatgaagccccaccattttcaggctgtagaaagtaagctggtcttccatcatgccacagatggcctcttaaagacctgcattaattcatttctcaaatgtttcctaagtgagcccatgctcaggggaacagcagctcctcccagccacaaaaaacacagcgatgactgtggtcccactgtgtctccaggctctagtgactctccctagtgtgctgggctgtgtctggtctgtctacagggccatcaaccagcaattgcttctctggtggtcagtgatgcagagtggctcaaagcataggcaccggattcagacagacccgggttcaaattccagggctgtcacctgttagctgtgtgagcttggccaaattacttaacctcactgaaaattcaatatcctcatctttaaatgaggatttaaatatatgtatttatgccaaaatatggcaacaatctaagtatccatggagggacaaaccaaagaaaatgtggtgtatatatgtatatgtttatgtatacacacacacacacacacacacacacacacacacacgaggaatattatccagccataaaaaaagaaggaaatcttgccatttgcagcaatgtagatgaacctggaggacattttgttaagtgaaagaagccagtcacagaaccgtaaaaactgtatcttctcacttatacatggtgtataaaaaagtcaaactcacagaaacagagagtagaatggtgtttgccagggactggggcacaggggaaatggggagatgttggtcaaggggtacaaacttttagttataagatgaataagttctggggacctaaggtaaaacatggtgactacagttagtaatactgtattgtttacttaaaatttgctatgagaatagatcttaagtgtcctcactatacacacacacaggtaactgtgtgttgattaatttgatttttgattgtggtaatcatgacacagtgtgtacatatatcaaatcatcacattgtacactttgaatatatgcaatttttggcaattatacttgggcaatccaacatactttacaaagtgattggaaagattagatgaaacactctgaggtaacaagagatgctgctgctattatttctattattattggccaactctaggcataggctcattccttgcagatccagatttcagtaaagtaagcagtcatctcaaacatggggctgatgtttcaaacagatgggtagacaagctcagaaccatggggccattccttgtgtccagagagtgctgaaggttttgaactcaccttggcattggaacccaggagcccagtttggaaacactgggcattgatctgttgggtactaatggcagaatccacactcctgatgtgtttcaacatgactgtggtgatagattggcctctggaaagggctgctctgtttcctgctatgaagaataatcatggtggcttctggtaggccttctaatagatggtgatataagatttgaattacttcttctagtagaacctttggaaacagacagatatggggttgaaatctggtctggttatttgcaaattgtgtgactttgggctctctaagccccagtttcctcatttgtgaaatggaaataatcattcttaccttgaaagggcattagtgaagtaagtgtaagtacacagtggatatgcaatatttgattattattattctggattaggctagagagatgtgacacatgctaatatggagaagtattgccataataccatatatgctggttccctggttatctggaggccccccctttcattctcttagtgagtttacaaccatttaagggctagtacccagcttacaggtccagaattggtcatgactgtctcagaccttgtggaatttaggagtgttaattcacagtatccaaatcacaagaaactgaaggatataaaccagaatgctactacactgactcattttggaaaagacaactataagtgaaaagtatgccatatggaccaaaaaccagtatatagtactttatccctacaagaaaactaaatgggaagtctaattatggtcaggagtttgcatagtgatttccaactccaagtgaagagaatagttctgtaggcaccagtatttgctaggatccactctgatggccagatggtccatcttcctaataggggcttggctgccaggcggccagagattcacatccagaagcaagggccctttcccctctgggccccagggaatcatgctgccaacgttctcctctccattttcattctcgtcaacaccaaatcctcttcctgattgacacattctttctttacgtatgctaatgcaatcgataaggttactgagcagttcttgcactttctgcttctggtgtgggaaacattttgtccctaagatgccttttgaatatgtcttatctcatctattatgtgttgatttttatagttgaactttcaaaggaaaaggaggctgcctttacatctgacacatgcttatagatggggattatcaacacgcctccagagacatggatggacattcctcccctaccttgcagagatccgggtagaagcctctttgcgctggattaatctggctttgtatttcgtagtgccgtcactttcctgagaagtcttacctttataccttggcacacgtcatcgtcctgagattctgtttcctttgatttattgatgccagagtgactaaggacatttcatttattaactttctttttttctatgtgatctctatactttaaaaaagactggggtgtcttcctggaaacataataggaaggaatgtctgtttcatgaataaatcatttgtgtagtcaaaatgta

SEQ ID NO: 212 - DNA, 2432 bp, Homo sapiens
caggtccagccaatgcattcagaagccaaaatggtaagtaacagttataatcaccctttcattattctgtgactttttcttttgaattttactctgactccaaaaccttagttcagctaggtagagggctccatctttgttttggtgaatgaaaggcagtgcagagactgcctctctttttgaggatgtttgttacagagccttggtgtcagataatcatgtaacaagcactggattggcaagtggtattaatgaaaggaacatttaggagttttggtagatccatacaagttggggtaggatatacccaagcgtgtatatatttgctcagcatgtgaaataataaaaataatacaaaactactcattcttcaaggtagttacagtttcaatgccactcttcctgtccccatattcattaagacagaagcttgatgcttaaacacacactggtatgaaaatgttttgtgttttctgttatattgtcagaagtgacattgatttgaaaggatgagagccttattttcttgcaacccttactgaaaggcatgatttcaggtgaaaatcttcagtgatttttaacatatgttacatgtttgcagtaaggtcagtctttccaatcacagatagagttatgcatctatattctaccaaatattagcaaaaccaatgcaatacgtgtctgtctttgcaatataaagtaagcttggtgattatatttagtggagttacttgaaataggtcatttagtttacatacagtttaattctcatgccacaattaataaggtatcacatgactgcaaaatacactgcagcaaactttctagcatctgatattggataaggatagcttgtgctagaagttggagattaatctggtctgctgactggcagcattagagactgtatctgatggttggtgtgaggatgttgttgacagttctgaaagttagccatcaattcctgtgcagggtggagtcagacccagtgacttccttttcaatgtcagcaagagttttctcatgcctgctttggtcactttctcttggaaacttcacgcatttgacttgcagcttcttgacccgaggaatcaactgagctcccagtgctggctaccttgggcaaataaaatctgtggttgagagagttctctttgctgtgccacagtccctgtgatgtgccaaatggcaccagcatttgcagcaaagctcgttaaatctttttggaatgggcaaatattttttcaacttgagccctgctgagccaaaccaaatacttgctggcagaataaagttcaaactggcaactgttttggagaccaaagtaatgccatatatctttttttaaaaaaaaaaaaaaaaagaaagaaagaaagaaagaaaagaaagaaaagaaaaaatgaactgtgaaggtacttaagaaaaataaatgtaagttcttcatgtatatgaataaatactcagggtctgtgtctgagatgttactccctgtggtttactttggaatcttcttatctgcttcagggtctgtaccttttggagggaccttccagatagatattaggtagattctaaaacacaattccaaactgaatttctctgccagttgattttcactggattttatgccactgcttgactcaaaagtgtccttcttctcttcttgctggcaaagaaggaaaatgcttccaaaggtggtgcaggtttatacttatttatacgtatgaaataaatcatatgatttggcaaatgaatagtgaatcatgtcagttggaaacaaagggaactggtctgtacttataaaaatagttttaccccacaaatgtttgttgggttaaatttactgagtaagcacaccacgaggctgattcatgttctaagaaaatgaatatttccaggtccacagcatctgagctaatgaactctatcatagggttggggcttagggagtacagctattctctgccccaagctcccacctctacccctgttattgccaatacatcaatttgaagggaaaaatggtagcattggctgctcatgtttgaaagaatagtactggaaaaatgttaagtgaatttgaatatgtcactcagcatctctgttcttattatgcttgcatttttactggagaaatcagttattgccatatactaaccatatagtattttctagcagctttgggctgctcagatgaaaagcttttacgaaatacaaagtagtgaaggaaaaaaaaaacttgcacgattttaatgtcagccagagcctccccaggtttctctgaactatgggctttgttgttctatgcctaattttcttcctgtgtaagactggaatggattccagatttcaactaaaactcttgtttcactgttttcaaggacttttccaaaggtcacacatggactattgtgatgaatgcactctgcagg

SEQ ID NO: 213 - DNA, 20379 bp, Homo sapiens
gctggaagtagtccatttgtttagagtatcacaagtgtgtgtgtggaaatgctcggatgaagaactgtcaagttaccacagggagataaacagggttatctgaggcggaaagttaggctgattctctgctaggaggtctcacaggatatcatttctttagtgatgctaccgtggtgtaggatttactggtttcacctgtcaatagctacaccacagtcagttttataggttcagagactaaatgtgtcactatgctagatcctcaggctggaattacacagcaagcagacatagacaggaaacgaaagaaactcaactatttttaggctggttatagtggaaaaagaaaaattttagaaaacaaatcactgggccaagtgcattaagatggataaatgaggatggaaaagttacactccaaagaaacttagctgccacttaatgtaaattttttatcttaatttgaataagatattgctaaatatcaatattcaagtatatcaaagcataaccaatacacatgcatatatatcacatatatgtatactatttatatagtgtcatcatattccttatttaataaactttctaagagttcttataagaaaattctttctatagttaaaataaggacattgctaagaaattacacatcaaataatgtcatacacagaattatagaataatgaaaacgttgaatgcatttaattccatatgcctactgtttattgaatttctaatgtacaatgtcactggacaataaatatgaaaataaacatgaaatagttcctaatctccagaattccattgtctaggagaggaaacacatgtgcagtagaccataatatatagagagaactgatatgcgagtttatgtgtagtgtttggaaaccaaaggaggtagagagattgattctcgctgtaataggacagaatcatggtgataacagaaatggcatttaatttagactttaaagtttgtcagtggttaatagtgttagtggcaatatctctgtctaaagaatgaaggatgatgttacataaatgagcaaggagacacacaggctgtaagagtgaatgaggactaatacacagcaggtatattagtctgttttcacactactgtaaagatattaccggagactgggtaatctacaaacaaaagaggtttaactgactcacagttccacacggctggagaggcctcaggaaacttacaatcatggcagaagacaaaggggcatgtcttacaaggtagcaggagagagagagcaggggaaatgccagagatttatcgaacaaccagttctcatgagaactccctcactatcatgagaacagcatgagggaaaccgcccccatgatccaatcaccccccacaaagtcccccccttgacacatggggattacaattcgagatgaaatttgggtggggatgcagagccaaatcatatcagtaggctagcctagatatggaagggttgcaaatatttaattagaagtttagatatggcattggctagctgggtaaggctttaaacagaggaacacatgtatgtaagtgcttcacaaaaataatgtagaaagcaatgaggaagatagaagagactagagggaaatcaggtaggaggggtttaggagtaaaacaagatgaagattaaagagatgcttatttggaaagtaagagcaggtatttagaaatacaagagcaggcatttagaaatacagaaaacagcacagggaagggactgggagtgaactttcaaatgtttttaaactatcctccgttccagagtttcatattcttttgtgaccccctcactgaatttctttgatttttttcttatctagtatagcattatattgcaaagcctactgcattatttcttctttcattttggatcgttggtccttgacttgtggttattaacccagaaatgattctctcagaagaggctcagtttctggtgttatctcggcttccttgcagtggcctgtgtcaagggaatttgtttgaaaagtaaaaagtgtatctctgtgcttttggcaaccagaatcaaaactctatctttctttgctacacttaacacccttttaacttctccgatcattctaaccagttcagcttctgttttctctgtattgaaagtgcatgaatccgtgtcattgtatcctggcctcttgactaaaattacaaatacagcatcaaggcaacactcctaactattctgttgttgcttaaatattacagaaaaaaattaaatggtctatagcatttgactttcatctcttttatgtaaatatgtatttggtttatttagaaatcttaaattagtttcttacaaatattttttgcccctcttctaacaaatttaggataagcaatacttggtagttttttgtgtcatgaattaatggtataccaacataaatcttgtaatattaattttattaagtaggaggttatgttctcagtctgtttttgtctaagaaaacatataaaattgtaaatgacttgctagaaaattaagaaaaaatgtttctgagtatcctcacaacttacagctctttaaacgtaaaattaaaattattttcctctattctcatgttgcattttgcagaaaaaattcatattaatgctgatgatagtccttataagtgttactttttaatataaatatcagtattaaagagaaaactggagttcttaaataacttaaaaggcaaagtaagcagaaagagcatttaaattaatagaacttctttaaaatacattttttcttatgttctaagttcatttgctttgatattgtttatacattttttgtttgtgaatttttgttgttatttgtaattaagtttaaattttaaaatcttgaaataatttttgcccttttatgatatacagtgtagtttctatgcagattatcattggagtctgcgttaaattcaaaatatattcacactatttcttcaactgagtctttgataagtttaagtacactaagtttgttttactaaaagtgttaatttctgaattatagtaacttaaaatacacatcgcagctctcttttggaaaacgattgtgtaataatttaaacaatgtaagagttgaacagtgcagcacatgctttgcttatgtgctgcaaacagatacaggtttcaaatgagcttcattcttctgcacaaaaaatgtttaaaatgtacatgatacttgcatttggctaaagaaatcatgatgaaacttcaaggaagaagcatggacaacttacttgctcattagtatagtgtgtacaagcagatgagattttcaatatatacaactcactagacaactacatttgtttttaggttcaatggtaaatggatggggctctgcatctgatgaggatcgtaacttttctagtcatagatctagtgtaggtagctcctcagatggctctatctttgccagcggcagttttgcacaagcactggtggcagcagcagataaagctggttttaggctggatggaaccagccttacaagaacaggttggtagactccaagtcaacactctttgcatgagagaatcttgtccttggacactgtcctcttttctcctgttctttctccttagtgagtctgactgtagggctttctttaatacgcatgaatacagtttggatgctccattacccaaactctcttctgatgctagttttgcagagccaagaatagactcctcctcaacactttctcttattttcctttctcttcacggctttactgattaattggaatatgcttcctttttatattacggcaaagcagcaactaagattgccattaaattttcaataacacattttgcaaaatcctcatacaattaataatgtacccagtgattaaaattactcagcttttatctccattactttcctttgcctcatctctttctgcaaatgcattttctgggaaggtttccttagcatggggtgaatgggtctaaggttgtcggtcttaccagttcaaatagcttatgatctttttaattgtttggctagtaagattttaatacaataatttattatttgtcttaaaggatgctaattaaagatacacccactgcatttgcaagttgaataaaataatgactacatgtgtatttctctttagaataatttaattttgatttctgagagtgataagtaatcatataaaagaacaattatataatttttcaagtgctgctcattccacaaaaaagaatgtgggattaataatagatcagtaatttgtaaacttttgcaacaaaataacttaggcatgatgcgtgcttttacatttgtatgtataattcttaactatacatataagaatattctaatatatgaattaaactgaattaccttgcaaagcaaactaataaaacattaagtacatttgcaaaatcttaactgtaatcaaatagtaaagaaaaaagatttttacccttcactaaactctcaggttataaaaatgagtcttggaagttttcttggaattataccatcaatatttcttttaagcatacattagctatctttaagtgaaataaaaaagatcttctaagcattgcagaggtttatttttcaaatagcatccaaactaaaatacgttgtaatagaactgttatttgaattgtcttgcattataaggcataagtctgaaactttatgttgcttgagtgctttttgcagcattagctgtaaacagagcagtgagaacgtgcaaggaaactaatacattagaaggcacaagtgcatttcctgcatgtatgctaatagctaacacagcattaagtaatatcatatcacgtcgtcgtaagaaaatgtaactacatataataatgttgtatgaaatgaaaacatacacaggagaataaatgcatgcacataaaccaggcctctgttactacaataaacatggtattgaaatcataagttgttgaaaatttattagctaaccttttcccagaataaatttccccgtatacctactctaaaccacaagaaaaggacacagcacatatcatttttcaatgagaatttggagcctgctcagatacaataatattaatcagaaaatacctattgcatgctggatatacaaggtgattttaacctgctatcctctacacagatgttgttgagtttctgccaaaagagatagaattcattgtgtatgtggataagtggtaaggtcaatttaatatatgtgtctgagcagacctttcatgtaaaatttcagatgtaattactatatgacatttttctgtgttcagagagattttgtaagtttccaaggatgaaattttattaaacaaatacaacagtatatacttcataaatagcttctttaattttaagaaataaaaactgcatgaatttgcatatatctttgacaatatcaataatattgtcaaggttaaataaaagtataatcatgcaatattgagttgtggattggtggatctgttttatgttcatttgtttgattttgagggggccagtgggggtgttgttagcttattaaaaattgaacaaaatatgtgcagctgagaatgtagaaaatacatttttctacagagatgcaccaatatttggtatcttcatatgttatctctaggtagatttacaggttagtcatagtgcagaaatataggacagaatcagtgtgctataatgtcattctctagaacccattccctttattttcattttaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatggtaggtttcttccctttactcttgtttcctcgctgaagagacgtgctccatgcaatcatttacttagattaatgtagtcatggtagattagccattgcttcattacataacaagacaaaaacctggcaatatggccttgtttaaataaaacaccatttttaaaaacaatctagaattatttctatattattaagcctcaagaaatacattccatgcaattttttgaggttgatttttttttttttgccattctggcatatttcataaatgctttttagtgagcatttaagagtagggaagaacataagctgcatgtgcacttatatgatcagaacttttatcatattaaattacaatatcttagctgctatttcacttttggaaaaaaagacttttgaaatgatttagtaattttttagtcacaaatttcagagccaaaatcaggctacagtagttgaagagtgtcttagtctgtctgggctgctataaaaaaatagagtcatgcattgtatgacaatgtttcagtcaatgacagactgcatataagacagtggtgccataaggatgtcatactgtatttatgttgtaccttttttgtttaaatatgcaaatatttaccattgtgttataactgcctataacattcggtacagaaacacgctgcacagatttttaccccagatcaatggtatgtagtcagctataccatctatgttcgtgtaaatatactacgtgacacttgcataacaacgaaatcacctaacaccacatttctcagaacttatctccatcattaagtgacatgtgactgtaccataagctggtagattccaaacaacataaattttctccacaaatctggactctgcaaagtccaagatcaaggcattggcagatttggtgtctggtgaggacccactttctggttcatagagggtgccttttcattgtatgatcacatagcggaagggacaaggttctctctggggtgtgttttatagggtgctcatcccttcatgaggactccaccctcatcatcgaatcacctgccaaaggccccacctcccaatatcatcacattggggattaggattttaacgttgaattttgggggtacacaaacatccagactctagaaaagggtcagcaaacttcttctattaaagtctagatagtaaatatctttggcttttgggacatagggtctctgtcacaactactcaacactgccattgttgtatgactgcagctataagaaaagtagaataggccaagcacggtggctcaggcctgtaatcccagcactgtaggaggctgaggcgggcagatcacagggtcagaagatcaaaaccatcctggtcaacatggtgaaaccccctctctactaaaagtacaaaaattagctgggcgtggttgcacgtgcctgtaatcccagctactgaggaggctgaggcaggagaattgcttgaaccagggagtcagaggttgcggtgagctgagatcacaccactgcactccagcctgggcaacagagcaagactccttcttaaaaaaaaaaagaaaaggaagaaggaaaataaaagtagaatgatggaaatgattgacttccaataaaacatcattcacaaaatgggcagtggctggatttggcccatgggccatagtttgctgatctagctcaatatttttatttatatatagcatccaacatttgaatacttgcttaaacactgttagtttcaggaaacacaatattactggaagatatccatgttcgataatgagtatttcattagctttacagaatatagtctatttcccgtatttttaatttaattcttataacttttaaagaatgaattaaaatatgtatcctgaagttatattctaaggatatgtaacacatatttaaagtgtgtagtacaatgtcagattgaaaggtgaatttctttttccttttcagcactgtaccctataagcacacaaacattatcctaacatagttcaattaaacaccaaaaggataaacttttaaaaactgcacattagaaccatctggaaagctcttaaaatataccctagatattcagatttaattattctggggtgaaacccagttacaggtaattttaaagctccacaagtgaatctaaagtataactaccttagagaagctatgacttagtccttagcacacttacacttatcattataggacagaatgaagcttagttgaaaaagaagaaaagcattggttttttattagtttggggaagggagtatccaatcctgcagccctatttgtgctttcttttgtcatcttgcaaaggtaagaggacttaaaaagccaaatatattgttctacatactttccggtttacttatctttcctgcttcctttgttttcaatagaatatgaaggttaagggtagaattgagatttttgagtctctataaatgtgtatcctgtggtgagtaaaaatggtcaccactgcctttctgccttatatgttcagaagattagctgagcatttaaaactattcgtagtgttcatctaattcttcgtaaataaaaaaggactactttcactgaattgctaggtataaatctagtaattgataattttgtatattttttctgttgtgaatattgtggagagagaaaaatgtctaggtatagaattttctgtggtttttcagaaatgtttgaagataatattcagaatatgtggaagatataaaatataaatcaacaaaatacagatctctttttttctaagacacttttattgcaagcttttttagaatgtttccttaaagcaagctacctcctagtttaaagtatgatcaatatattgcttatctttctaaaaaataaatgtttctaaattttcaaaattgccagcatttcaaaaaggggttatggattatgtgttattagaaaatgatacattttagaagtagtgatatagcaaaggaaatttcagcccacatatcttcccaagtgcttaatccaaagccattttaattatgatacagtgcaaagacatttattttggatggtgctctacaggttatccttaagaacattgttattttgcagcaaatgcatatgccatagcatttatatggtatggatccatatgtcagaaataatttcataactttttatgtaaaaatcaagttgttctttttgggaaggctgatacttagcagcattgattgtacagacattttacaataaaccttttgcattatagattttacaacagtgtttgctgttttctaagcagtattgtaaagatgtaggcctttttagcactgggataccatcatttctggatcagacctttatggtttctgaggggaagacagaacatgagtggttgttgggaggttgtaatggcaagtggcacacatcacttctatttcattgaaaacaactctgccacgtggtgtcaaactaactactggggtgagaaagctgccttccctgtgtcccataagagagattatgaatggtgggaaatgtcagtctgtatcccaaagactgaaaaacccacacacatcttaaagagtgttcttctcccttttgtaaagtttctccaaagcaggcattgctgagtccaaatcttgtattccatttgtcttataaatcaaagaatacccttggaagccaatatattaaccaatgctaaaaaagatagatctgtctatccatcaacctgtttctcctagataatttatttccagcctattctccctttcacctagctttttttttttttttttttttttttgagagggagttttgttcctgtcacccaggctggagtgcaatggtgcgatctcagctcactgtaactcccaccttccgggttcaagcgattctcctgcctcagtctcccaagtagctgggattacaggcatccaccaccacacccagcaaattttgtatttttggtaggtagggacagggtttcaccatgagggccaggctagtcttgaacttctgacctgaggctctctgcccacctccacctcccaaagtgccaggattataggcatgagccaccatgcccggcccctttcccctagttcttaatgtcctgttcagagaaggggctctttctcagctctgccacatactagctttggcctttgagcaaataaatttacatattaattaatctattcactcaaatacttattaagtatataacatataatagacaatgggagccaaacagacaaaatcccctgcctttttatattttagttggggaagatagataaagaccaacctaagtacatacatgaacatataagtaagatggtgataaatgttatggggaaaaaacaaagggaagggagttgagaagtataggtgtagggaggaagtatttttaagtagagtgactggggaagtcctcaccaggaagtcagcatttcagaaaagactggaataacataagcaaaaaagtaatgctgatatctgaggaaaggttattccaggaaatgagaatggcaagtgaagcttgagacttatttgataaaaaggaaagggaacgatatgactggagcagagagagaaacaagatagagtacgaagtcaggcaagcaaacaagggctagtgtttgtgagacctttaagctaccataatgacattggctcttactttgaatggtaaaccactggacggggtgtgtatatgtgtgcatgcatgtgtgtgtgtgtaaggcagggaagtgacatgatcttatttgtatattttttaaaaagtcattctattctagctgctgtgttgagatgtactaaatgaggcaaggtggagattgtggaagctacctagggaatagatgacggtggttcataccaaaggagaatcaatggcagtgttaacaaaggttggattttggaggtagagctaacgggagttgttatgaaattaacataggccataaagaaagcaaaccacattactctgaaattttggctaacttgtagaatgtaactgtgaccaactgagagaagaaacactgcagaggaagcattttttttttttttttttttttttttttttttgagacggagtctcgctctatccgccaggctggagtacagtggggcgatctcggctcactgcaagatccgcctcccgggttcacgccattctcctgcctcagcctcccgagtagctgggactaaaggcgcccgccaccacactcgggtaattgtttttgtatttttagtagagacggggtttcactgtgttagccaggatggtctcgatctcttgacctcgtgatccgcccgccttggcctcccaaagtgctgcgatttacaggcgtgagccactgcgcccggccgcatattttatataggatgatctagagctgagttctcatacatgaaatttgagaagctttctgaacacctaagtggaactgtccagtgtagctctggttacatgagtctggagttcatgggaggaaagatccaagctggagatttttaattactttgtgccttcattttcttgtctaaaaacagaaggtaataatggcacctatctcattggactgttgtgtgcctgaaaagagctaatcctcggtaggccagtaagagactttatagtgaattgatttagtggaaatgaatcaacatagaaatgaataataaatttaatttaagtaaatgtatttgattacatacttttatttttcaaaaaaccattcttaatcccatgtctttttccaattagtttatttcagtgtgcatgtaatgtcctttcttaaaatatacaaactccaaggatattacttatgaagctatataattttaggttaaattaaataataatcagaattttagctgcataagcagatgccgttttggccattttaaaaattaagctgctctgatgcagaataaaaatcaatgacaagataagttattttggaagaaaatacaataatttctcctcactggcagtctaagttcaatcaatcaaatgaaataattaatttgcatttataataacatatagtgaaggaagtcagtactatcgaatataaaggaaacaccaaactcattggattatccaacaaacagatatctcaatattggattagctcttcattttggaaaaatattccaaatgcaactttatcctccgaaacagagaccctgttcccttcagttattagcaattcataatttaacatgaggacatacgtaagaactggcaatgctgctccaacttaggaactcagaggagatgctccagagaccaacattatcagtccaatgcagattagtatcactttgctcataaaagagagtataaaggttcttgaagtttttgaaaggagcggcttagctgactgttaaggaagctatcttttgtctacaagaaatttatactttttccttctaaatttcacaaacagaatattattagagacaacagaatacatttacaaaaatggcatcagaaataattgaatacattgtgtacaatatcttctattaatgaaataaatgtatattttatatgatatttggtctttatgaaaaaataatataattaccaatattctaaggatgaacaaagaagtttacaatagcatgcaagaaaaatgagaagaaaatgatacaaattgatgttcagaagatttcaaaatcttcagcaaagtaatttcagaactaatacatacttaaaagagaaagaaagaactgtgatttcacagtcgaaggcatacaaaatataaaggtattatgatctgaagagttaataaaagagagatgaaaagggagttgatattggaaccttaaattttttcctatctgatatttactttaaagagcttttctgaaaaattatctcttctactctatctcaaatttctgtgaggcattgtcttctctagcaccataaaacacattcagtctttactctgaacattggttattacttattaaaattaatacatcggaagattgtaatatattagttgtaactcattagctaactcatgaaacgaacagccagaattggttgtcaagcagaatattaattgcatttaataaatgttagtttaatgttgttaaatgtgccacatacatgggtaaaggcagtcatatgttgcatatgacacggcatacagttctaaatttcccgagggtgacattccctttggagattggcaggagagcttttgttcttggggccttttgttagtacagcttcaggaatttctagtgatcttattttgtgtcatggtatttctactttggggaaggagggttggacaatggatggaatataaacaatgaactgccctttacaccttgaatgatagcctcaatatgtaactgaaaacactttccacatttaactgttgaataaaactagtcaattttgtttcaatgatgctatggccaaaagacagcagagagagcaataatatgagctttggaaataaataattgacttttattttccccaaattttttttgtatgggtaatacctgtataagggcaaagattttcttcaacttgaactaaaacctgtatttttcattaaattttagtccattctaaacattattcaaaatttttagatcttccaccaccaccagatcccccgccaggtcagggtttaaggcagcaaataggcccgagccagcaggctggtaacgtggaaaactcagcagagagaaaaggaagctctctagagagacaacatgcatccagcttagaagacacaaagagctcattggattgtccagctagaacctccctagagtggcagcgacaaacccaggaatggataagctccacagaacgacaagaagatatacggaaagccccacacaaacaaggtgtcggatcaggtgtgttctgcacagtcccaagaaagtgtggactgttaccatttcttttcctaccaggtattctagaaatggcagttgtttaagggcatctgaaaaacatttgccttcaatcgtaatggaatttggaattccttaggagattttaccagtacatgccttaaggctgattccaacgggcattgctcctcagtcagcctctccacagggtctttgatcccaagagacttccaggcttcatctaaacggctcagtagaaaattttattttttggcctattaatgtttatattgagtactttaaagatcgctaaatttaatcttttctgtcagtttaatctctgccttcagcaagtttgttcattttggctgaaataaccagtcattcgaaaggagaactcacatcaaatatgtgaattcattaaaattacaaagttgcagaaaaatgcccaatcacagatcctcaaattagataaggttatactgggcttgcactttctccaactgttaatcagttgattgatttagttggttgttaatctgtctatgggaaatgctcttttttataaatcaagcttcctggaaatgtcacagaaataaatttcattgtttgtagttagatttttttggggggagaggtgtggcgcgggaggtggggagcctgctttataaacgcattttctgagacatctcatgtcaggattcattgagtactgaaacacacacatacacatacacacaatctttgaaaaaatgtcttttcacttattcatttggacttaatgtgttgtagataggcctctccatgcatttcccataactacattttgtcacaacttggtgctcaagtttttggaaaatgtcatttgtgcaagggccagtagatgacaattttaatatctaggtttagtgaaacatttagaaaggttacaccattcaggctgtgagagaaaaatcatgtggttcttgtcattgaagactatgtaaggggagaaatagtaaattcagtgagcattaatcacaaaataatagcccatacatagaaagaacgtgaaagacagaggggatggggtgtggagagggagcaatgagaatagagagggaaagaaaaaacaatttttgaactattgagtgattatttgtaacatatgtcatgagttatttgtagagagacaatctgtaaaaaaaaaaaattagcatattatttatttaaatgtgtgagtttctcttttacttttaaggaaatacatagccctttaaataatgtatttctgtctcaaaaagcaacataaattttaaaagcttatttaactaatatatagttctttatctaaatcaattgagaaaatgttgccataatttaagctgaaacaaaaaacatgtttctttaatcttaatgggaaaattaaattggagcctcattgaactttagaaattattctcagatatgcttttgttaaactgtagttcattgtatgcagctctcttttataatgaatttaaattttgcaaataatatataacattgtgtacttatcccaagatctcttttaatttaattctgctttggttcctattgtaggaaatgttgcttgcacatagaaatttctttaatatccggtcctgattaaacttcataattttaattttattaaagaatgaaatggtaaagtaggccattcacagtgttatattcaagagttaagtttagtttgcctccatgtttctgttcaatttagcctttgggttttttttctttttcagaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatgtaagtgcttaggtcatttaaaaggctatcgtgattcagaaagaatcttgggttaataacattgccacattaaacaaatttcagattaatagaaaacttgctctgttacaaaaacaatcaattgcaattttcaacaagtttggtcataacttaggccattgctatatttattgaagtccatttttataaatgtttctgctatttcacgttggatttatgctataaaaattgttttaagttaggcaagtagtcttaacacttatacatgaaattaaatatagagtgtttatcattttctttgcctttttaactgaacacaataaagaaatggagacactggccttttggtagttttaaagaaactcctaaggaatgcttcattttcaagttactctatatttattttttaaatttgggtagtcacccttgaagagttgatctttgattgttaattaaattgtaatgttttgactacaataacattttataaataaatttccatttatgaatgaaaactggcataggtagttagtacaattaattttctaaatgtaaaatactaggtaatagggaaaattaagaatgtcacagcaaaaaatgttgaactccttgtgttaatttcctcaggaaagttaccaatacagctttgcattatcagaaacatatttgctgaatatttttaactgcctcatcagaaaaatagcattaccattatcttcacatcacagattgtttggaagattctgtgagatgatgaaaagagaaataatttcaaaattataaatttctttattgatctcagttgtcattgttgttgactattgctaatctattattaagattcatttataattttaatttgattcataactacttgaatttttctttaacttttttttgaagtaatgacagactcacaggagtaccaaaatagttctactgggtgtttacatttccaaattctatagtgttttctttccttttactctttgatcatctccttcaagtaaaattacttaaattcacaaactcatctatctgaagaccttattttcattgattatctgttggctttgctttttgttatgctggtcagaaaagcagaatgcttaatttatattttatttctacttttttctctttctttagagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgtcctgcctcatttgttttcacgactttgacaacaagaagttcctgaacattagtcatgtatgctcagaataaatgtgactttgaaatatatgttagctactgtacatgtatagtcagtcaagtagaagaggaccttcctgaaattcccacttgtgacattttcccatgggtttcctacacaatcttaaattttatttctgtctatactttctcaaatttttcctatgataagttcagttgttggtactcttctaaaaatattcaacgtgattaggatcagttctaaaatacgggacccctttgagtgacaattcgcactccatgcattattggctcagtagccaatttttgtcacgtcgttataacaaggagatgacataattaaacatttccatcctttctattccctgagactgcatcagcacaggcaagtatagaatgtaatgttcttcatgggccccaccagctttttggtgccatgtaatttatttcttcgctgaagagaaaaagaattctgagacacagttattaaaccctttatcaactttctaccatcagtgcctgaattctaatgcagtgtgatttctctgggacaaagagactgaggaagatgaaaagtttcttcaaagagtgaatacatacttattcacaactctaggatgtgaggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtaactggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcgtttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaaccaacatataaggtatcacacaaccaagaaaagtaaaaccattgcaagtttacttgcgttgagtacaaaacagatttaatggtgttctatgtcatagtttaatgctctgggtatttaaatatgttttcaacaggatttgagttgaaagtttgtaatgtgctttgatggaacacctctcaatttctattcaataaacttatgtaattgtccattgacaatataatgataacagtaccattgaactctaaactgtggtttatcttcactactgggaagcaactgtgcatcagtattaaagatatgcagaaacataatattca

SEQ ID NO: 214 - DNA, 7064 bp, Homo sapiens
caaggcaggtggatcacaaggtcaggagatcaagaccatcctcctggctaacaaggtgaaaccctgtctctactaaaaaaaatacaaaaaattagccgggcgtggtggcatgtacctgtagtcccagctactcaggaggctgaggcaggaaaatcgcttgaacccaggaagtggaggttgcagtgagccaagatcataccactgcactccagcctgggcgacagagggagactccgtctcaaaaagaaaaaaagcaataaatgctcttccagaaaactcaaaaatgaagataagctaaaagaaaatggaaagcaccagaataccagaatctttccactcactgatgatcagagttaatacctcaggtacccttttcgtctttctgtttttgagacaaggtttcactctgactctcaggctgaagtacagtggtgcaaatacagctcactgtggcctcgatttcccaggctcaagcaatcctcccttctgggcctcccaaagtgctggaattataggcatgaaccactacacccagccctgttttcttctttacgtgggtttttggggatgggttatataggagccatttcattattgtttgtggtttttctgacacaattctcatttcagtgtcactgttatcatcaaactgcttttagctacattggattttttggggttttttgcatagagtctcgctctgtcgcccaggctggagtgcagtggtgcaatctcggttcactgcaacctcggcctcccgagttcaagcgattctcccacctcagcctccccagtagctgggatcacaggcacccgctaccatgcccggctaatttttgtatttttagtagagatggggtttcaccatgttgtccaggctggtcttgaactcctgatctcaactgatccacttgccttggcctcccaaagtgctgggattacaggtgtgagccactgcgcccagcccctgctgcactttaagcagagagaaaaacactgtagtcataagagctattaaatacagtacataattttaaaacatttttgaaacacagaaaacacatacttttttgatctcaggaaggaggaggagttagtaggggaggcttgcacccatccatgcttctgagcgtgcactcacacatgcatgcacactaccactcattcacatacactcacacacacttgcactcatgccctttacactgtgcacattcagatccacaccatgtacactcatacactggcaaacccacacatgcatcacacacctacacttgcactgtcacacgcacatacacttaagcacgttcacaccctcatggttacactcacacgcacagcctcacatatgcacactcaacactcatacatacacatttacatgctctcatttatacacactgatacatccacacaccatcacactacacacacttttacatgctttcacacatacccgttggatatggacacaccaacaagcactcattcccacacatgcttgcactgcacacactgacacactacatgccttcatagttgacacacacttccatgcattcactcacctttttgcacactcattcacactcccatcacaacactgacacacttctgcctgtcctcacacgcctacacacttgccacacacacactgagtgttccatgcacactcacatcctgcgcattcagtcactaacttaccctcatgaccacacacacacagactttcaaatgcactcatccacagacacatattctcatatgcatacgcacttgcacacaaccctcgcacgcttgttcacactccctgacatgcagtcacactagccatcactcatgtgctcacacacatacacactcacaccccctttgcacacacacttcccccacccactcaccccaagcccacctgacaggtgacacactttacctgcgggctgggatggctggtcctctgcctgggcttcgaggttccttgggggcagcggctcatgctggttttcccactgcagtgtcttctgtggcttcagcgtcacctagtgcaggctgccattcaacaaacgcattgtcaacagtcaaccaaaagaaacccattggccaccataccctgaggactaaccctgacacagatgcccttccagatgccctcaatagtctaactgattccatcgccccagccttgggggagaagcactgctgcctatgcactccatttacaggtgagactgggagaggtttagggagtggccaagtcccctgcctacacagctgcctcccaatctatcttctcaccctcccccttctcaggctaaaatcacactcgatgtttttatgggatcatttgatctggacattgtcaaagaaaaaattgcaccagacaagttaaaccttcaaggaaggactcagtcaggactactgcaatacggaagagaggagcttaacttcattgaaacaaaaggctggggagtttttaagtgccggggtgagatgctgagaaggaactggagacatcaggaagaggttaggaaatgccgtaaagctatctgcgttggctcattggaatttttcaaaactgggaatctgcccttctacaaaaactgagacacagatgtatcatctccttcaataattgcattttaaagggatggctctgaagtcttgagaaaggcattcctgggttgcaaaactaggaggaggctagaagaaaatttgggagaagatttgcctctcaaagaggtagagaaagaactcacaattgcaagtttcctaaaataaatcctccgtgaaaaaaggaggcctgatggatggaactggaggtcattatgttaagtgaaataagccaggcacagaagaaaaatactgcatgttctcactcacatgtgggagcttaaaacctggatctcatgaagatagagagtagattggtagctaccagaggctgggaagggagataaaaatagtttgattaatgggtacaaataagtaggggtttttgtttttttggagacagaattctgctctgttgcccagactggagtacagtgatacgatcgtagctcatagtaacctggaactcctgagctcaagtgatcctaccacctcagcctccccagtagctgggactacaggtgcgtgccaccatgccaggccgatttttgtattttttgtagagacagggtctcagtagattgcccaggctggtctcaaactcctgggctcaagcaatcctcccgccttgcaaatacagagtttgataaaagaaataagacctactgttcaataaatcagcagggtgactgtagtttacagtaatctattgtacatttcaaaatagctaaagataagaatttaaatgtttctagcttaacgaaaaggcaaatatgtagggtgatgaatatcttgatcacaatgatgtgatctttacaaattgtgagtgtatttagtaatcacatgtacccccaacatatgtgcatcaattatgtatcaaaaaaattaaaactaaaaaatagacaaggaggtcgggaggaaaactgtgtaacagtcaagctgagggaaatgtgaaggctgtcttagtcaacagatttgcctttttccctttaatctgctaattatcaattgatatggtttggctctgtgtctccacccagatctcaccttgaattgtaataatcctcacatgtggtggaagggaactggtgggagctaactgaattatgggggtgggtttttcccatgctgttcttgtgataagtgaatgagtctcagaagatggttctataaagggcagttccccctgcacatattcttctgcctaccaccatgtaagacgtgactttgctcctcttttgccttctgccatgattgtgaggcctccccagccatgtggaactgtggatccattaaacctctttcctttataaattaccagtattaggtatgtgtttattagcagcattgagaacagactaatacatcaataactccctttgaggacattttagctgtttggaaatgtctgctcctatcttgtttttgtttttgtttttttgggacaaggtatcactctgtcacccaggctggagtgcagtggcacgatcttgaaactctcaatataaatgcctaaggtgcagcacttggcagataagaagccatatgcagacacattcttttaaaagaacacatcattatttggttctttctcatgtgagagtcggatgactcagagccaacataaattccaagtggtatgcagaaaaccaatgcatagctggagagggtaatgaaggttagtatctgcagtaaggctgagtcgatgcaaacggccacacagtcatggattcacaatgatctgggtctccatcatcctgcaatccaacaccttgcacagccttcaaacaccagctgggaattcaaaagtggcatgtgcggtagcaggagatctgttcaccctcttatttcctctcatccccatgtagcaatctggtgcaatcacagctcacagcaacctcaaactcctggactcaagtgatcctacctcctcagcctccctagtagctgggactacaggtgtgtgccaccctgccagactgatttttgtagaaacagagtcccactaggttgcccaggctagtctcgaacttctgggctcaagcaatcctcccgccttgcaaatacagagtttgataaaagacctcctgaggtcctacagagagaagtctttaagctccagggcagagacaatttgcatttttctcaccacccagggaatgctaactgggcagcccagggtacccgggagctcaggccatccagtgtcctttgagatgttaggaggaagcagaacagccagctgccaaatgaaacacggcaaaatgctcacccttcaagggtctgcttttgttttgtttttgttttttgagacagtctcactctgtcgcccaggctggagtgcgctggtacaattttggctcactgcaaccaccacctattggattcaagcaattctcctacctcagccttccaagtagctgggactacaggcacgcaccaccacggtcggttaatttttgtttttcgtttttttggtagagacggggtttcaccatgttggccaggctggtctcaaactcctgacctcaagtgatctgcctgcctcagcctcctaaagtgctgggattacaggcatgagccaccgcgcccggcctccctcaagggtctgaatccagccagtgtcctacgtcatacctgcttcagcctatgcaatggagagagcctgagattttatttcaataagaaaatctactgagttgcattacatcaaactaaaagggagaaacacaaatataaaaaataaaaatccagaaattccaacactaggcaaccctccaaaatgtggcaaagctctgtgtatattaaaaatgtattgagtccgggcacggtggctcacgcctataatctctgcactttgggaggttgaggcaggtgatcacttgaggttaggagttcaagaccagcctggacaacatggtgaaaccccatctctattaaaaagaaaaaaaaaattagccgggcatggcggcaggagactataatcccagctatttgggagattgaacccagaaagcggaggttgcagtgagccaagatcacttcactgcactccagcctgggcgacagagtgagactctgtctcaaaaaaaagaaaaaaaaaaagcattgaaacatgcgacatccacctttttgtaatagttcccatagcctacacaaatgcatatgaaatgcttaatattttgcttgcactattcttttctgctggaagggtggttctgactaaaaaattttactttcccattctttgctttttcattaatgctattttctttgctccagggttatagagtggaaagtcccacaatctttttcttctctattttcaggtagatgcattttattactatattctatctatccatttattccatctatctattccatttatcatctacctacctattattatctatcatctatgtattccatctacctgtcattgatctatctatcatctaccaatctacatttttgtcttgtagaaaaacgttgacctcttggcgagaatgcaaagaagggaacgcttgcttatacgctgttggtgagaatgtaaaattgtacaatctctatagaaaacagtatgtagatttctcagagaactaaaaatagatctaccctttgacccagcaactccagtaatggttatctacccaaaggaaagaaattatcagaatagacacctacacttatatttttattacagcacaattcacaatagcaaaatcatggaatgaacctgaatgttcattggatgaagaaaatgtggtatacacacaccaaggaatactatgcatctataaaaaagaatgaaactatatcttttgcagcaacataaatggagctgcgggtcaatatcctaagtgaaataactcaaacagaaaatcaaataccacatgtcctcgcttataagtgggagttaaaaaaaatgggtacacatggacctatagaatgacattaacagacacaggacaccttaaaaagggggaaggtgggaggggatgagggtggaaaaattacctatctggtattatgttcactgtttgggggttagaaggccaatccccaccgctaggcaatatatccacgtaacaaacctgcacccttatgccctgaatctatttgtttttcaacattgacttccatggtcactatttgtgaaatcactcctcatgaaccaggacttgcatgtttttttgtttctcaggtgaactgtcacccctacaactcagcttgcaaccagccctggccaccagtttccccacactgagctgaatatcggacatgcccatctcagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaatta

SEQ ID NO: 215 - DNA, 3204 bp, Homo sapiens
taggatcccagggaggtgtaaactcagtgcttaattaaatggattctttagagggtgggaaacaggtggatgtcaaccatttgccccacatacccgtattcatgcaatccacccccagtgggctcaccggtgcgggtgtgcaaaacctcctcccaccccagtcatcttaggttcaggtcatcctttggtcctgctctttccccgccaggctgtctgttgatgctacttttaatctgctttcactaagataagcctggcagaagtggtgggggtaaggtgggctgtaggccagctcccaaatgtgtgctgggcataacagaagacccattcttgactgaagtgcccttgtgggaccctgagcccgtgccctggagtggcacagggaggtgtgccagcaatggggaccgaggtcactggggactgctggggttcgggctagtggcctgtctggctgctgtctgcttccctcgttcacatcctgctggagccttaaataggagcccaaaagcttttctttcttacttttttttgagacaaaatctcactctgttgcccaggccggagtgcagtggcacaacctctgccgcctgggttcaagcgattctcctgcctcagcctcccgagtagctgggattacaggtgcctgccaccatgcctggctaattttcgtagttagagtagagacggggtttcaccatcttggccaggctggtcttgaactcctcacctcatgatccacctgcctcggcctcccaaagtgctgggattccaggtatgagccaccacgcccggcctaaagcttttctattaataatttcctgcctcaccctccatccccttcctcctcagacacctggatttcattagcatcatgacctacgattttcatggagcctggcgtgggaccacaggccatcacagtcccctgttccgaggtcaggaggatgcaagtcctgacagattcagcaacactgtgagttcccagaaggagggagggccaggagggggccgcaagacctgccatctgccagtgctcacacaccaatctctctagccctcagtacagtcctgcaagaggggggtcatgaggcccattccacagataaggaaactgaggcccaaagtctgggcatgctgcgttgctctgggaaggtgatctgcagggtaaatggagtgagggcagggggccgaatggggagaggctgggagccgaggaggtaggagtcattgtgccctcagagccaaccacctgatttctgcatctgtcaaatagtaatagccccttcctatgcctcaaaggatttttttcaagaatgaaactgtaaaattcactttaaagtgacatgatccgttcccggagggacaggggaatccccagtgcaccatacaccaataacccctgctaaggcagcagtattaattgctcaaccttccgcacctgtgcactaactgctcacgttgttcccaccctaccccacccaggactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgaggtaatggagttggggagaaggtaggattcccccacaccaccagcagccctggggaaggtgattccccaccacgttcttgctttttctcctttgggaataaagaaaatgtccggttgccccagcatgcctgaggaagtggaagggagaggttaggacatttgttgctgaaaatctccagcaggtacaggcacatgggcctgcaccactaggcacctgggatagccctctggctatggggctgaggtcttccttccagcccaggaaagagcagaggtcaagaggcagattttttgtttcactctagcctctgctactctgtgtggccttgggcctgtcctcagtgtcaaccagcaggcctcacatctctgtttaaatggaagaagctaagcagggccaaggcagccaccatctctgggtcatttgcctctggtttgtataaacttgtgtgatgcatgcagcctgcagaccctgcagagagtgaggctgcaggatggagcaggagctaaaagagatttggagagtggcgtctcctggtgacctgcaaggtctcggcacgactccccacactgccttttccctgttatctgctcagatctgtgacttcctccgcggagccacagtccatagaatcctcggccagcaggtcccctatgccaccaagggcaaccagtgggtaggatacgacgaccaggaaagcgtcaaaagcaaggtaggtttccccaaggccacacctcaggacaaagagaaagaaggaggccccgctcccagcagccagattcctgtcccttgcactgaggtctgggctgggctcacagagcacatgtgccctgtacacactctgggtcagggaacccagccctgctcctctgggcctcccctgccaggtgcagtacctgaaggacaggcagctggcgggcgccatggtatgggccctggacctggatgacttccagggctccttctgtggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacagtg

SEQ ID NO: 216 - DNA, 8188 bp, Homo sapiens
cctggcctccacagccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggtgagcagggctttgggctgggctgcgtcccctctctgaatctcagagcccctgcaggatgctagggtgggggagctctttcagcgtgtggtgcagccctgccccctgcccccaccaggacttgtttctcaaagtggttcatggagatgtcaccccctacgacctggtgcggatgagctcgatgcagctggccccccaggagctggcccgctggcgggaccaggaggagaaaagggtgagtgctgagcccagtcgggatgggtgaggggatgtaggggcagagtgggtggcctgagagtggaagagggagagacagagacagggagggagggaggaggaattcagaaagacagaaacaaggaaacagagaaggcagatagggagtcagagagaccctccccacaagagaaacaggagaaggggtggaaatgaaagggactgggaatggagagcttggtagagatgtgacacacttggttttcagttgagctggactgtggggtggggggcttgggagaggactgtggtgagacctagagtccggagtcctgaggtacctcttttccgatcccagcttcagatgccctggaaaagcctggaggtcttcctggtaccccaggttgggggaggggccccatagcccctgggttcacagctgtgtccccatataccctgtatccatgggtctctccctgcctgggaactgctctgggacagggaagctgtggcactgagcaggctttggagaatgctcacctcatgtttgttggtggcccagtgagagaagaagggactgatttaggggctgaggccactgggatggggcgaggcactccagcccctgctctggaagacactgaactgattagaatgaataaccaagagtccatcaggtgaatctgtccactataggctgagcttctgtccaggctctgtgggggccagggatcaggactggctttgtaatttgtgggagccagtgcagaatgaaaatgtggggccctttgttcaacaactgctaagaatttcaaggtgacaacaacagagcgctaaaccaagcgtgggcctcctaagtgcagggccctgtgcgattgcacagatctcatgcccacgaggctgatcccaccagagaggagcagacctcctgttctccaggggttgttagaaaaggagagacaggttttcaggaagtattgcagatagagtgacattgatcgacagtaagactcacaactagcatttactatgagccatgttccaggctaagcactctatatatgttgtttaatatagtgctttaaattaaattcctacagaacagataaactgaggcttagagcagctaagtgcttgccccaggccataccatcttatgaatctttattaatggcccagtgggaactccagagcctgcactctttcagcaacaccacacccttcccagaaaaggatgaggtaccgtcagaggttgaattgacctgtgagtgaaagcgaaatccgggaaggcttcccggaggaggcaggacttgaagggtgaatcagtggaatacggagaggtagcgctaagggtggagggcttcccagaggaggggtatggcggaagtaaaagttttgaggagaggggaaccacaagagaggggcctcaagggaggaaagtgagcacttgggcttttgatggccagaggccccctaactgggctcagcttggcctgctccacctcttcagggcctgaatatcattgagcagcaacagaaggagccgtgcagacttccagcctccaaaatgacccacaagggcgaagtggagattcagcgggacatggaccagacactgaccctggaggatctggtggttaagttggagcctgacctggtgctgggcagagcccatgcctgggggtcccacgcctcgcctcaccagcagtgtggtcttgggcatgtcacctgactgctctgaggcccaccttgtttgtgataaaacggggacagcgatccttaacgcataggggaacatggggtgggacagtgctgctggcacaggcctgccagcgccttgtcactgtcggtcctcctccttttggcctcaccccaaggcccccacatgagtggtattaagtcccatcatcatagtcatccccaacctggcattctgcccagatctctgctgggaagcagcaggctgcgctgttccaggcagtgactttttcagatggaaggaacgaagacccactgtattcagtggattggtttagggatgctccaggcagggaaccacccggcaccctggcagtccatccagagggcctcctggaacttgtcctcagacctgggaagccaacgggagtgacaatagtctagggctcttggcgctgaggatctgctccatcctcatgtccatcctgctccttcctctcccttggccctggcttgcacatagcctgacatggtggctcagcagccccagaatccatgaagccatcatctcagactcctgcagttgattagaactttcccttggcttccttcggtcactctcagaaggccactctggctgtagttgaatgttctgtgggtcagatgttcacctgggtctcatcagctgcctgttcaggagaggggtgcagggcaggtccctttaactatattcagtcagtcagtatatttatggggcacctaccaggtgccaggcacggttctaggcactggggaagtgacagtgaacgacagaaatccctgctccccactcctaccactaatattcaggccaacgactgggagaacctctacctgtgccaagaggatccctaaggggtgtggctgctcctcagtctaaatcagtttgtattccctgaacaaactgaatggcaatgtaggagaaagacctagatagccccagagaggaagagagagaggaggtgggaggggaggggaggggaggggaaaataacacatgatagctatctttactgtttattgaacacctactgtgtgcaccttttacaagcagtgtctcattcacatctcacaatggcctaggaggttggtgctattccctgcccatttctgggatgaggaacctggcaccaaggtcacatatgtgcagtggggaagctgagatttgaacccaggctggctgactccaaagcctgtgctttgagactgttctggaggtggctgataagagtagagtttcaaaatctctttaaaccttcctaaagcaatgattgttttatgtttaaagctatttctagtatgaggaaaaaaagtgatttggcaatagacgtcaagagtctttaaaatgttccttctccctgattctgtcatctgcttctgaaatcttgtcctaaggacataatttaaagtttaggaaactactttctgcacaaaaaatgtcctcagtgctatttagtaatagtgaaaacctggaaatgacccaaatgtatagcaacagaggtgagacgtccactccagtctcaccccatcacagcagtgtctacggggactatatgatgtgacaaatgcctctgctattattagtgaacaaaaagagaacaccaagttgaatatatgatcccagctgtttcaggaaaaggacccccaaaccctgtgtatagaaaaagattataaagggctgggcacggtggcccacacctttaatcccagcactttgggaggccgaggcgtgtggatcatgaggtcaagagatggagaccatcctggccaaccaacatagtaaaaccccgtctctactaaaaatacaaaaattagctgggcatagtggcacacgcctatagctactcaggaggctgaggcagaagaatcgcttgaaccggggaggtggaggttgcagtgagccgagatcgagccactgcactccagcccaggcaacagagcaagactctgtctcaaaaaacaaacaaacaaacaaaaaaaaaaaaaagaaaagaaaaaaaaagaaaaagattgtaaaggaatacccaggatatcaacagtggtctctgagtggtgtgacaagaagtgattttctttttaattttcaagttttggtgttttccaaattttctttatgagttcacagtattttggtaataaaacaacatttattattgagaaaaataaaccacatcctggggccccctacccatggaggcctccgggcacccccagccacgttttcagcctgcccctctgtcttctgcctcccagggaccgcagatgttcatggactgcagcccacaggccctgcccatcgcatcagaggacaccacggggcagcatgaccaccacttcttagaccccaactgccacatctgcaagggtgggaggggacacgggaggggtgcaggggtggcagccaggctggggctgagcgtgcagttcagcagcaacagggatttgtggcctggggagagggtggcagagcaggggtgcccgtgccccaggtcacctagaaaagaacctggttcaaccctggctctaaagccctgggctggcttcagcgctgctgctgcccctgtttcagctcctgcctctgctatttgcagactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacaggtgtggggttgggagcagggaggtggataacccagcagggttgagggggaggccaccacctggtgcaacagacatagcactggcttttcctgtgtggccttgggcaagtcttccctcccttgggaacctcactttccccatctgtgcaatggaactaatcatcccagcctcctggcagccccctgcacaaggccaagcttgggccagtgttccagtccccacagtagggacacaggatctgctctgaaaagaaaggaggtgccggggaagtcctcatggcctgctctgtctggccctgtcttctgtccctccctctagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggtgcacctgccctcctcgccagggattcccttacacactgaccagcccaggcagcctctctctctctctctctttcactcatgcattctaaaacaattcatgggcacccctttctgtgcctggccctgtgcagggcatgggggcaaatgagatgttggtcccattcctacagagacaaacagggtgaaggactccctgtcacccatagcaagaagggcccaaaggagggttttaggagtgatcgttgagtgacttaatgatcagctaaagtgtcggatgagagcagaggatagaggagggagggaggggctttggagaagttgtagattagccagtacaggctgcagacctccatggggcaattagagctttctgggcagccactgagggtcctggaacactgcctgcccatatttgccacaggctgcagccttccaggtggctgggaatgcgtccaccctgagtgggtgggaagctggggagctgactggccatccttcctgcccctaggctctgcccaccgtgatccgctcggcaggctgcatcccctccaacattgtctgggaccttctggccagcatctgcccagccaaggccaaggtacctgcccactcttgggcaccccctcttttcctagtaccttactcccacctccctctccacttctagagcagaggcctggcttggatatctgggtctagttcccagagtgactgcagactcactgtgtgaccctggacaggtccctctgtttcctcctctggaagatggagacatactttctcacggggttctcaggggtttcagggagcccaggggtgttggcaggagcagaggatgactgcgcttacagctgctctcctcctgccaccgcaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggtgagtgcctagtccccataccagaccctgcctctgctcacttggtgaccagaccaggcacggttgacacagtcacccagtagaggcaggcacatctcagaagggaactcctcacccagccaggcaaatgtgagtacaatgacagtaatagctcacgcttggatatcatgaactgcatgccagccattgttctaaaagctttacctagatgaattcttgtagtctcatcaccctatgagaatggtactattagactagactgtccatctcatagaagaagaatctgagggaggaagaaggcaaatgacttgtccaaagtcacacagtcagtcaacagcagaactgggcttcactctgttcacacgttgtgtgaagcacaacatggcttcagaaacctggcccctaaccaccacaccacactgcctctcaaggtaggcacccctgaagagaaactccagggacagccacatttgacccaggcagcaggacagagtcaggacctacacacacttgactgtaaatgtcacctcagagaggagggagggatgtttcgccacagccacggggggccgagctcggcctctgtgcatggacaccctccacggcgtggctcaggaaagcagcgaggttggcagtgggcgctttgcccactcctgagcaaagcgcttggccttttggggctccatgtcctgagacaatgaggtagactttgagtctgtagagtcttcaggtcaaacaatccataccccagcctcagccagataagccttgatcccgcagagctcaaatcttccgagacagccccaccttcctacttacttttcccagcatctcatgggccccatctcactgtgaagaagcccttcctgggatgtaggctccagatctgctgcagctaagctgaacacagttcttccccgcaggcctttgggctcttcctgtctcccctctcctttccccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgaacttcctgtttgacaatgtttgctgttgattttttgttcaataaagaatttggtaaaa

SEQ ID NO: 217 - DNA, 56498 bp, Homo sapiens
catgaacggaggggaggactttgccagccaggtcacgcgcaccctcgactccctgcagggctgcaatgaaaagtcggggatggacctcacaccaggtggggatgggagaaaggcaaggggctgtttggtccttcatctcaaggagctggggagtgggtaggaacagctgtgtgacaacagctggttgtcctacatagtgtgatgtggcagtgcccttccctagataggcaagaataacctgtttcctgagatgatgggagctgttttctaatctagaaaaccagaagaaccgtgtaaattggatcttctttcacttccaccaggcactggaagcaacatactttaacgttcaacagaggagtgagttagagccattttagtatgtaatgagcaaccctctgggaaatgagatagcaagaaaaatgaacatgtgtatatgacttcttgtatattttatacttgcttaggcaatttaattctccattgaagcggaggggacagtggtatctgctttttcctatgactcctgagaattgggcctggggtgttttctttatgtttatcttgctcatgcctctgtgctctctacaagggatgcacttcttcaaagaaaatgaaggattgcaatcatggtatcagaccccagatgcattgtgtatctatggagacactgactggaagaactaatccagatgaacaagattagggtcaaaaactgcagagagagaaagactgcactcttcctttacagtaatctgcctatttctctttaaaacttctatgaatcagcaaatctccatagataaacccttgacagtgatccttcaaagaactgcccaattatctttgaggaagacatgtttgatgctgaatgttgcttactatatatagactttcagtggggcttgaaaaagtggaatcacatagaggtttttattctgcttgttctctacaagacattctacatgaagagccaatttctaatgagatttaaagcctgaaaattccttgagaatatgggggacatatcatcaacatctcttcatattgaccataacacctggtgtagtgctaagcccacaaagtagacatatggtactcaggggttattatcaactcaaatgcctttaggaggccaacagataacacagatatttgaagcagagaagaggtcagacaatacagaatggcgcagactgtgatgaaagagaaggggcatgttctgcctgaatgcacacaaattcaaattcttttaaaactctgtgctgaccaaaaataaagaaatctgcagtctgtatttagccaaagggttacaagtgctgaccttatcaatacagaatattataatacataatataataatagttgaattggattttcagttgtagttccctgacttcactgcttctcccataactttgcagtccctcagaaataaaaaaggagtatttcagtttcttgcagccagtctctcagtttgctggtgtcttatttcaattctgtgagaccttatcttcttggtttatgcagatttccttcttctccctttcttttggtcttttctcttaaagtttttgcctcgtcttttccttatacaggaagtgacaatgccaagctgtcactgatgaacaagtataaagataatattatagccactagccctgtggactccaaccaccagcaagccacccttctctctcacacctccagcagccagagaaagcggatcaacaacaaagcaagaggtatgcatgtctgacattagggctcgtgggtggattccttcatattggtagaggcagggccattaatatcttctacccattctctcatgcgtggctggagagggtatgccctggcacagcctttctggaggccagttaaatgctacttaccaaaaaaatgtaaatgtgcaaaccttttgaccaagtaatttcaccaacaagagtctattcttaggaaataattggacaagtgtgcaaagaagtgtgtaaaaggccgttcatcacagcattgtttaaacaagtgaaaaattggaaatagcttaaatgtccatcaacagggaattggttaactacctagcacatctgtctgctgtccagcacttaccatgcagccatttgaaacaatatagatctatatttgttaatatggaaagttgcccacccatctattaaatgggaaaaaaaatgaagttataaaatagaagatacagcataatgtcatttttaaagagagattaaaaaacctttacctgtttctgtgtcagtaaaagccagagagtatacacatgaaatgttagcagagtttatctctgatttaaaggatttagagggcattagaattgttccctttacatagttttgtgcatttcctttattctattctgtcttttttgtattaaatatatataattctagagccagaaaaaacacaaagatgtaatttcctatacctcttagatagtctcatattaacagaatcataacctgtaatgagggaaatttccctttcttcctattccacccactttccctggaggtcctctctggcagataggtgccagaaatggccctagtcagagggaagtgggtggggcagggtagagctccagtgattgctgtcccaatggtctacttctccaacatatccgtgtatgaggaagccccaacccccttggctatttctcccagattatcagtcagcttactttcatttttgttgattttcccattgaacttgcccaaaggtttggtgtcatgaaaccagaactgaaaacgctttcttgaccatgctgctttcattacagctggttccgccttcttgaaccctgaaggggattctggcacagaggcagaaaacgacccccagctgaccttttacacggatccttcaaggagcaggaggcgtagtagaggtaggaatgatagaggtggcagaaggtggtaaaggatctgggagtgagggaggcgggggaaggcgaagaggtgttgggttgggttgtgggctctatggaacaaaaccagtttctgcaagaagaatttttggaccacaactggtgtttcctcctaaggaagaaagaagagcctagagtggaaaatttcagagaatcatctctcccagataatggcactctcaaacaagtttccaaattgtttgaaaggctatttcttggtcagatgactctcaatttcttctggaagactcaggagtcatattttgctgttcagacaaacaaagttaataaagtgtgttgtatgtgaaaagatggatactatatgtacccctgcttcctctaccacattggccttgggtttgagctaggcaaggattgggggcagtgtagttgaggaatgatctatggcctgaaaatctgtgtaattgtctttgacctttaagcccctgcctggtagaatcacaggaccccgagcctcccagttccttcctttcccctggcagggttaaggtggctaatccattctcctccacgtggacagagctgtccttccacgcagccactgtgtgccacttcactgtcatgatcagtggcttcaactgtggctattccggccacagctcccactgcctctgacttcacttgtatcaccaccacaccagcggagttcggagcacaagcgccggtcagctttaccagttatttgctgtgtggtactggataagaacaacaagttctctgaccttcagtttactcacatgtcaaatgagttaacaataccttgtgcgtagaacatagagctttatcaggattaaattatattaaaatgtgcctttttggagattgctaaagcactatgaaatccctattgttgctgttagaactctccatcatgcagccccatatttatacagtgccccatcttaaagaattttaggcagcgtccctgtaagatacagtagaggatatttgagtggcatctccttgtaatacattccataacaatttcctcaaccaatagtcaaccagtgtctcctgaaagacatatacatttttattctctcgtacctccacttgaattcccttcataacaggtgttcttcccagagatttgaagaagcccttttgattataaattccagtttctataggcttaactactatcagtataataaaagtttttccatcatttttctcaagagatcattgtggctctgggtattctaatattgaatggccaggttctgtgaggcgagaatgtggattagggtctcccaatctcccttgatacttattacaaattttagacagtggatacccaacctaggcccagctaatccaggcctaatcaaagcagggtgtgtcctgctttaataaagtcttgtttcagaaaaatccatggtaatgaattagtttctcgacagcatgaaactgttccttttaaataccaaggtctcctaatgcatcaactttttacgctattaaccagactgtaagcttcttaggggtggggaatgcctaatttatttttccaaagtgcctagtgaaggatttttcctgtaacagatgcttgtaagtgtttgttgaattggattggatatatccatcagtgcagcaaaaacattttataacccacctgctgtgggtcaggtttgtgataggtggtagaaacatgaaaatatggcccagtgataaggcttaatttaataatataaataaagtgaagagagtactcagaagagaggacagttaatcctacctgaaagcaatgggaggcaaaaaaggagaaagtaattagaactaggttttatatatatgtatatatacacatacacacacacacacacacacacacacacacacacacacacacacacacactgtactgggtttctcaaaagaggagaagaagtctaggataagggcatttcagtaaaggaaaatggcacataaaaagccttgaagggacaaaagaacatggtgttttaaaggaagtaaaagtcgttcaatatggcagctgtcatcaagttataaatatatacgcacacgagatggtaaggatgaggctggaaaatggctaacaaaggaccatgcacatgccatgtgactgagtttctgcttgcctcagtggggtgtaaggaaccattggaggttctgaaaccaggtagagatgctggattatgggtcgatgatgcagaaagaccatagagtcaggaatatccgtagcaagtcattgaaatcacatgagagcagtggcaattgcctgtaaacagtgatgattctatgtgataagagctctaacagctcttatcacaccttatagcaccaagggctagaacaccaaggaatcagtgagaatctgttcttggaggtttcagggaagtgtttacagggagatgttgtttgagctgagacttgaagagtaggtgtataccaggctgacaaggtgacaaaatggccttctgtggaggaggaaataatctgtgcaaagtcactgagacataaactatgatggtcttgtcagggagcagtaaaatgtttactagaatagagcttagggtgcaggtttgtggttttcttaggaaataatgttagaagatcagcagaagccagaaagtacatgagcttgattccaagggccttggacctgacaaaagagcaacatcctggtctgctctgctccatgaaggatcctcccagggacaacatgcaggataggtgacagcagggtgagcttgaggcaggggaacaggtggatggcttctgcttcagtttagatataagatgatatgggtagggagggatggaaagaatggaggccagataagttttggacacaaaatgagagaaacgcaaatcaaaactacaatgagatatcatctaaccccagttaaaatggcttttatccaaagacaggcaatcacaaacactggtgaggatgtggagaaaagggaacccttgtacactgcggtgggaatgtaaattggtacaaccactatgaagaacagtctggaagtccctcagaagactaaaaatacagctgccatatgacccagcaatcccactgctgggaacataccctaaagagacaaagatttaatggcattggtgagggcagggtgggggtgtggcttgtaagcaagagaaaagagttggatataatggagtttttaaatttgagcaaccaaatgtgtggcagtgccattggctgggcaatggaagtagttggaggagcagggtttgagagaaggtggtgagaggaggtagtgaggttttgagagaaggtggatctgcatctgaggcctgggctgggctggaaacctgtaagcgtaggaaaatagactgtattatgaaaggatagtaacatgcacagaatatttccatctatcaaggacagaggacccagagactaccttctgccctcaagtctctcctttccagctactgccaacacatgcacccagaggaaactgctcccctaaaggacaagtatatccataaaccaaaaactcatccctgtgttcctgaggacatcagttccaaaggcaccactgggcccaaagactgagtagtgcattgttcctgtgtcctgaaacctcacctggatctgcatttttatctggctccacaccttagtagtttcctgggactaggcatgctctccagcctctctaaccctctattcctccaggggagctgcctcctaagactggggacactagtcaatgatgcgagccacatcaaaccctgagcactggagcctgacacacaatcatcacttcataagtgttaattgccacaaggagcgtcaactcttacagatctattttccttatctgtaaagtgggtggttcccatacagactcataggcttattgtaagaaagcaaatattaaaaataaaataaggtacgtaaaaaaactcagcacagtgtctgccttaatggaaaccttttattgctatcaataataagtattaacacagagcagaagaaaattccaaaagacccacacattctgtcgtcttgctttcttactttcccacatctgttctgcttccataagcataaggctcccctgcttaatggcatttcgtcttctccccaacaggaaaaaaaaaagccaagaaacaaaaaattaaaaaaaaataacaatggtacaaaaaaaataaagaaacaaaacactcttccctccctatccctatttccacctccccaggagtgtttcttaatcctcagcaatgattatttcctccaatgattccaggactgtggagagcatcctggtgtgacaatgttgtctgctcatacagagcagacattcctcattttcctcattccaggtcccacagagtaagagtcacttggtaggagtcttgcccatagagtaagcacaagctcttccagctcaggaagttcctcctggagcagcagtgtgcactatgggggtggagttgctctgtgcagaatgccctctgtgaagagcgatgggaggtatagtgtgggattaaagcatcccgcccacccttggcaaaagcctggagcttagtaaggcgactagggaagagaatgccccctctatgatttctcctgtgaacttggcccaggaagagtgaaaatggccaacagactattattgacctggagggccaccagttggccaagtcccctctgactccaactgatggcatggtgtctgtgaggaagaaggtcactgaggtcatgcagccagagacagttccctccatgggctagttttgccaactgtctcccctgtttgccaggatgattggcaaaaagccaagttggactctcaatgccaagctttttaccaccatgtatcttgcttttgtctcactttcagtgggttctccccgaagtcctgtgaataagaccaccttgaccctgatcagcatcaccagctgtgtgattggcctcgtgtgctcctctcacgtcaactgccctctcgttgtcaagatcaccctgcatgtccctgagcacctgattgctgatggtgagcctgttcttctgaggatgcgaccttgccccccaaaaaggaaagttttctggttgggcaaaggctagagaagacaggagtcactgttacctattactctaccgggggaaaaccaaactgaaataagtaaggatgaggatacaattgtattgcccatagatgaacttagaacacaggttaaaaaataaactaaagtgatcacctcttcttctctatgccatctcccatttttgtttgtttttaatacgtctctgtctttgagagaaatgcacagcccactggctagaggaaggaaggcaccaagactcccttagcctttgaaaaggaaaaagctaagtggagtagtagaggtgtttaagaattagccatgctttggttttgtatgcctgggtgagaaattcctaattgcagtaacttgctgtaagcctagaactcagaagtaataatttactttcatccagggggaccccaatataatgagggagtaatataggttctgagagtccctgaatcatttaagcccagagcacctaattgacttgttaatgtctgttctctgagttgctgtaaggctggaaacaggtggggactgttcacgcagtgttagagggcctgcaattctcatagcacgtgaagacaggcagcagcccctgttctttggaggagtgccagtgcctgtggctgggtctgatggagccatgccatggccatcacagggctcctctgtccctgtgttccttaggaactccctggaaagacggaatggagcaaggcagcaggggactccattgctggagagttcaatgtctggcctcacagaggtccaagtgatggcccagcctctgtctgctgatcccttgctctggggctaatgatgggctaggaatggtgagagttaggatctctgattggtactaattctcaggttgggatttccttgtcttcggtggcttgtggacgtgtgctgtgttgcacatataggcatgcttcctttctctcaccctgcagggagccgcttcatcttgctggaggggagccagctggatgccagtgactggctgaaccctgcccaagtggttctcttctctcagcagaactccagcggaccctgggccatggacctctgtgcccggcggctcctggacccctgtgaacaccaatgtgaccccgaaactggtaggcgggagcaccgggcagcgggtaactgtcagagagatcatgcctcttgcaatcactcccttgaaattcagaccatgcctcccaactccccgtcccactgccatctcgagcctagaccatgcggactgcctgcatgtggttgggccgcagagcttattggctaaaactgtggtcattttctggcagaagacttggaaggatactaactgtagtcccaagccagaaaactcagttttaggatgacttccataacccatttatcccatagtcaggggatatttaaatactggggctagacattttatgatgataaaattaatgcatgtttattgtagaaaactttttaaaaattagaaaagtttatagaagaaaatgataatcatcaatatttctatctcctggataagtcacttttaaaattttaatgtcctcccttccagtctctttactatgcatgatttttaagggcttcctagaagcatactaagtctagtagagttctcctgcttttttcacttaacattccatcataacttttccagaatcattaaataatcctcaaacacataattttaatggccatttggtattccgttgtatgtctatatcatagctcatttaaacagtcccctattatttgacatttaggatgctttaaatttttatttttataaatactattaaaatgaacatctttacacataaatgctggacacatttgaagttattttcttcagataaatcttagtgagagagtactgggtcaaagagtaggaacgtcttcaagtctgttatactatcaaatggagctggggtttccctgagggagggttcaaattctagtgtggcatgaattagagctctcccattgctccttgggttccaacaaagccaggagcatggatctcttatttcagtttgctttgcactttcactgaagaagacattcacctacagtagtctctatgatggcttgtttttggtaaattgagtaccacaaatagatccttcccaaagtagtatgatcccttagagcaaaggaaagcgttaaagtgatatctaagattcccaagctaaacgttgctggagttggggcccaaaccctgaagctttttgtacagcatgtgcagccaccccccgccaaccccctctaccccagcccaccacactcgcatcttcttcaggtgctgaggtagagagatcttaatagaggatgagtctaagatatctagcccttacttctgttataatctatgactagatccctctgggagagtagcaggtaactgaaacatctaaaattcaccatcttaggtgttaaagttgttttatgtgggcccatcacagagattctaggcccccatatggaggagaaagtacaacattttaaacatctgaagtctaagactgtgcttacttgctgctcctcccacgctgtcaggcaaacaccaaaccaaacagatgggctgtgtaccatgcccaaaagctagtatgcttgggagaaattaaaaagagctaatctcagaggtgggggctctccatgcaactgagctagtctctggtaccctagttctccagctggcttggattggaaggatttgggacaatctcagttgttaaactcacttctgagagaagcttgatccccggggggagctttggatgctcctacttggattttaaagaaaaggaagcacaccttcagttacatgtgaaaagaagggattggtgctttaggcttggaggggtctcaatgataaactgcctctatgctttacattcacatttgaattccttaagaagttacacgatttgcccaaagtcccacagctacctaaagcagagtctgtgttttatttatcatgaaatctgcaaaggtgggattataaaggttgcttaatttccccagacatgtcagatccaacatagttgtcattcaaaactatttaaaaaacaaccattactaagcattactgttccatgtgccaggaagctgcttgtctacagcaaagctctcccatcaactcttcagtcccttccagatgtctcatttctaatccctgctgaaaatgactttgggaagcccctcccctgctaatagcttctcaatgtctgtgaccatgaatgaatttcctattggaaagacacagaggaagactaaaaataatctcccaaaccccaagacaaaactaaggtgcagcatcttcattttggatagcagctgagaaacaatactgcaaagactctcattttcatgaatgctggaattggaaagcattggtgatgtggtcatcccacatgctcatcagtaagaaactttatcgcctcccacactctatcccagagcctttctccaaagagctgagtgtgggaattggcttcaagtcaagtcgacgttatttttgaaatcctctagctagcttacttggaaatgtcatagtgttgggacatgtgctttcccagccatactgaggggtctgcccatatggatgcatggagctgtgcagtgcacttgtgtacttttacacacacacacacacaaacacacaaacacagatgctcagtcactgcaaaggagcagcctcctggtgccagagctctcctcaggcatccttcctaagagcatccccaagtgagtctctgtttacctgtcacctgcaccatgcttcagaacaccaggtgtgagagacacaataatgcactcccaaaaatgtccacattctcatctccaggacctgtgaatgtgtcacgttacatggcaaaggagaattagtgatgcatatggaatggaggttgctaaacaactggctttaaaacagggagatttggggggaagattatctgagtggtcaaaatgtaatcacaagcattcttagaagtgaaatagggaggcagaaaaggaggtcagagtgaggtgatgtgaggaggactcaagcagccattacagactttgaatatggaggaaggaggcatgagccaaggaatgtcagcagcctctagaagctggaaaaggcaagaacacagaaaatagattctcccgggtgcctccagaaggcaacatagctctatagacgccttgattttagcccagtgaaactcatgttaaacttctggtaagataataaatgtatgttgttttaaaccactttctttgtggtatgcttttactgtaggaatagaaaacttatacactaaggaaggagagaaaagataggccaggcgtggcagctcacacctataatcccagcactttgggaggctaagggaggcagattgcttgagcccaggaattcaagatcagcctggacaacatggcataaaccccatctctaataaaaatacaaaaaattaaacaggcatggtggtgcaacacctgtagttctagctactcaggaggctgaggcaaaaggattgcctgagtctgggaggtcgaggctgcagtgagccgagattgcaccattgcactccagccacagtgacagaatgagaccctgtctcaaataaataaataaatagaataaaaagacaatacaaaaatagaaagaaaaagcattgttttgctccctctttatatcctccttgtgcaatttatagacttttcaaagatgtatcaggaatctatggaagaactggagctggagaatacttgctgatctgtttttcattccagcctccctctgtatttctattctagcaacatgctacctgggagggatgtaatatacctagagcactcagcccaatgcatgggatatactcagcactagcaactgttcttaagatcatcaagtgcccaaaggctttccaatttgaacttggatgcacttgagaaatggtaggctggtaccccaaggtatgcctgccattcccaatcttctgctgagcactgtgacctcttctaacagttctcattctataacaatttatgtttttatcatttggctgtctggtaattcagcatgcatgtaaattaggttcattgcattgacaatttcagaaagcctactgtgtgcccttccaggtcaggggagaccagtgggaaatacctaggaaaaaaatggttttcggtaaaaataaggataggtgatgtttgagagctcactgtgtgtcaagcattgtgctttacttagattacgtaattggagcttcactgtaacactatgaagtagatggtactcttattcccattttacagagttgttgacttatctgcccaagatcacttacctagttaatgacctagctggacttcaaactcaggctgcctgactcagaactcacactcctgaccattattcaaacctgtccccactgctcaagctgcaggaaaggaactaagacagaaggcttagaattgtttcacttctatgtggctgcagcagagccccagccccctgatgctttgctgttagccccctttgccaactgcaccctgacattctctcccatatgtccccaggtttgtaaccccaggtgtgcctctggttaagtggggctaacagcaaaacactagggctgcatggcttaatgctccctggatccagccagaggttgactttccctgcgctttgcaagggtttttttgttatggttgtatgtttgtttgattgttttggttttgtgtttttgatggagacacagactacctggtttcagtgacctttctctttcctctctccctggccttcattctgccatatggacagctgttggcttcacacacctgctttatttcacagcccccatcaatcctggccacagacccctcattgcccttttcaagatatgtagcttttatggttctgcaaggagcataggcttcccagctaaattaagttttaatctttatccaagacgttcactgaaatctcttctgtcccaggtctttccataggccagacccaaccatgtggaaatgtgtaaacctgttgaggggcattcgacccacttcccagactcaaaccagctgccctcttctttgcttgctctgaaccgctgtctctctctctaaccttccctgtttttgtttgtttgttggttggttggttggctgattggttggtttggatttttacctaatttggcagggtagctcagtcccgattttgttcctgatacctggattgctaacacatgctacactccgttctgtaactccattaaagcaccttcctttaggatgttcttttggcacacttccctctgactcccttcccagagttgcttggggctatttgaccctggacttgcctcctttcgatgtctctgctgggaagggagatcaaacaattagataatacccaagtcagatatcttacaaagatttccctttttagaaggagcacacccaattttatttcataaaagccaaccccttcctgaagcatagaagcggttgagggcatttggccttaatctgcattttcctcatggagaacttatggtgagcccagccatgtctgaggacccctagcttcaaggtttttctttaatctttgaatgagatttatgcctcagtccttcagctgtagaatgggaagtgaccaaaagcactgtccatcatccaaggtacctcgaggcgtctactgtcagggtaccaagcacagatcaagtgcagctgtctccagaccctgcaccaactacctttcagggccttttctttttcacagtgtggttgcatgagtgctcctgcagggcacactctgtctggctgggctctcctccgtaccatgacacgtctctccgttggagtcctatgtacaccaccatggagtcggcgcctcatgcgttcccaccatctgtcacagcagatgcagagactgtaacacttctagcttaggagggcatccaacacccttgtggggtctttaaaattcacagctaacagtcggagcctgtgctttcacgaaacccctcttaaagtcaagatttagcagttggttgccatagcaacttcccccatcaagtctgaaatcctttcgttggagatggccaaactggttttgtggaggaatacagacgaggaatgcttggtgggttccagaaataaggatcctgtgagaggcaaattttggagatccccaaaacctagcatgatgtgtttgaaaatttctctgtttcttggactttgggctgcatctgccattatgtggaggaaagctttattggttgtcggcagtatgtccccacattgtaatgagtgacggaagcctcataaggagataatgactacgaaggcaatttcagaaggtaaatgtgctatacaaatggtaggtattgctgtcattaggaaaataaggctcggcttgaactttgagttgttactgcatttatttttatatgttttgtggtaactagatatcaaatgtgaaagagaactcccatttttgtcaatccctaattctaggcaaggcgtctagccgagaccattctaagagtcagagtgatggctttgacaaactcctaaggttacttcctgcttctaaatatgcccatggctaattgtccacagaaggacaaccaggagagtgtctttcccgaaaggaaaagtatatttgagaccttgacctattaactggcttacatatctgcatcttgggggtgaggtgtaaatatctgtaaatatagggcaaatcctttaattaatttattttctactgcacagtatttgtcaaagacctactcatatgggggaagactaacctcgttccttgtttctgccctatgtatcttatagtctagcatccgtgctttctttggaattgagaaggtgtgaagccttctcaatgaagccaggctcctggtactctcttcttttgccctccccagtagttgccttctttatctttccttttctcaaataaacagccttcatccacaaaccttatcgtcaaccatctaatttaaagctgtgtttttctatttttggctcagagctccctgaccatttctagatatagctcagtaccactgaagccaataaacttgaacctactgtggatccagcccatgtagaagccagaattcaccatgcaggagacaatgtcctgatcaaatactccctgtgggcttttttttttttttttttacaaatgaagaggttttcactctacttctcagaacattgagctgaactgctgtgggggacaaaaatggtgtgatctggtagtgaggctctgatggacagccgcttgtaggtcaatcttgaaatgaatggctaagctaagatgctaaaaaaagctcttgctcaggccctatccaataccttcccccttaactgtgaggccccttcacttcgtttttactggattttatcttcagaaaagagaaaatagcactcaaagctattattctatttatatcatcttaaagtgtttctttctggggagataaagaaatggtatgcccatcatttcactagggcatggcacctttgttatttacaaattttggaaagtcacactttgttctttcacaaggtataaattaagcagacatttaaatagtaggaactagtgttgtagtgtaactggcctcagtagtttgggctacatctcattgcataaagaattattaacataatgaagcagcaaaaattttcttcaaaatcggtagtaaatagagcaatgattcttaatcttttggggatcttggatttacttgtaaataagatgaatgttatgggaccctgcctcaaaaaaaatgcatatacacacatatacagttttgcatgaaattccagaagattcatgggtcccttggtatactaatggaataacaaattataatgaaatgtagtgatatcctaaataaatgtggaattgtagatgattcttctggtgacccactcccagataattaatcatttttacttaaaagctaaaacccagagttcctttaaaaccataatagatgtaagaggcctcctgtgcatatagtagttgttctatgagctagcagcctggcatggtgggagaaaaaggtctggagtcagacagacataggctcaaacattaactctgtcacttacaagctgtctacaagccttcaattttctcaaggctgtttttcccattagcataacatagccaataatacctactttccaagattcctagaaatatttggtgaaataattcacttatgcagtctttaaacattattattcatctactgtgtgccttgtagtatactgggcattgagaaaataaagatgaaaaagtccttttcctcaaagaattgttggtctttgtgcttacagaacatatataatagatgctttctaaatactagattcctcttctatgaaaagtatcacacactggagaagggagagattggttggagtattcatttatgtgagtggtggagaggggagtatatgacataatggaacttactgtctcattcatgctaatatcagagtaagagtttaccctgactatttcatgttaatttttacaaacacagacatgttaatcaattccttcatgtttctctttcttcctccttaccctgcttctaaggggaatgcctctgctatgaaggctacatgaaggatccagtacataagcacctttgcattcggaacgaatgggggacaaaccaggggtaagtgagggcatgacgacttagctggttcccacatatcactgctccttacacagacatgacgtggagcaactgcatggagaggaatagagctaaagggtggctatattctgaacagcaaatgggtaaaaatgtcactatgcctttccatatttataccattccagtgacgtctatatcatctttttctccatttacgagcctctgactcgcagccctgcagcttccagctgggatctgaaaatcaagctgtccctctcttccttttcacaccaccaccagccatgaggattccacaggcagaatttagctgatgattttgttggagacacatgaagccacagagactccaatgtagctctcccagagcctgatgagctttgcaagactgacatgagtggaaatttgttttcaccaggactgtcagcaggggtgacatacagagactcaggaagtactctgtattgaataagagagtatttttgcttgatccccaattaccatttcccaatgagacttttgttttcccctagacacacacgagtgggacaaagtagttatctcatgtattccttttttgtttttattttttacattttggaatgttttattgggataaaaaatatataacatacaatgtgtcatttaaccatttttaagtatacaattcagtggcattaagtaaattcacattatgcaagcatcccactattcactttctattgccttttttttttttttaattgagacattgtcttgctttgttgcccaggctggagtgtagtggcatgatcatagctcacagtaacatccaactcctggcctcaagccatcctcccacctcagcctcccaaagtgctgggtttactggcatgagccactgtgccctgccctctattactttttaaaagcaactttttagtttcctttagatgttgagagttaactttctgcattggctgggtcctgaaggagggtgggaggagaaggggatcaataaatgcgaactaataatagcaatcaatggaacaggaaaaactagaaagaaatcaaggcaaaagccatctcagaatggttgcttggattgcaaattagatatgtgtttgcagcttgacaggtggaaaaaagaaaccaatgtcatttcagacatcgccatggaggactcacatccctgaggtcaatgatctgccccttccgtgtgattctgatgagaccaaacctagaatactgaatgtagttctggactctcaaagcaataaatatggtgacaaatgggtgagcgtttggagaagagcaataaaaatgattgaagagcccaagggagtgatttatgataaagggatagaagaactcaactctgagaacttagccagctgatgactaagtcaaggcatgatagatgcccatagatgttaggagagggcaaatgttctggaacaggttgaagttgggggataaggacaagagaaaatgcagttggggaaaggaaatctgagtcacaggtcagaaaacttggggaagtcaaaacgccatgaaatttttctgttcgtgaaaatgaaggattgctcagttttggcagaatttgagatcatatcacagagagagcccacaaattttagaggaaggtgtttgtagaagggcagctacatatgaggcagcctgttattgaaagattggggagaagggcagaaggtttggctgatagatgtgcagtgggatatgaatgagtaataccactggctatttacattctatggagtccccttaccatctttgcctctgaaatgtttgcatagtttctggggatccaaaattttagctaatgggatggctaagaattgcggtggactgtggttcttactgattaaaatagtgtaaaaaagtgatggataaccaatctctgtctcttagctgctgacttgctgctggagaaaacaatgacaaaatatttcacttctgccctgagtgatccaggctggctcgctgtagtgactggatttggtggttaatcactcaagcctccacatctctagccttgtagacagatcatgtgaggatgggcctgacttcacttgataattgcataagccttcatcattccctctggctgtatgtagagacagtcttaggatgtagacaagagtctcaggggaaatgtttgaggtcccagcataagtgtcatttaaaacaagacaggctaaagcagtgagttatagactgacagaaacattagccccaggaaatagacaagaagacctaatctgtcatttccatctttaatttccattattctatgatcatcactgtctatgaggtctcattttggacactaataaaataatggagcaactgttaggaggaggaaaaaagtgagtaccttgaggataatggaaccaggagtgataagcagtgtgagtttatatgtactcagtatttaaaaagcgccagacaaatgactgtatttttcctcataaaatgacaaggtaagtgaaaagtataagatgccatacatcttgatttaaatcagggatccgatgccatgtttctttaaatgattctcacaaaattaatcgaaatttgtttgaacatgaagactgtcactcgaattgaaaactgtctgacagattgccaactaatgatacatattggggtattatggaaaaatcaatggtatgtctgattttcctgaatattttatttaattctcctgaagtggaggtaagcagcccatgtgtgaatggttttcacttcatattcttgtattgcgtacattaaaatagctgaacattcctttgaagtagaacaaccaaatcctaggccaaatagttaaaacaaattctttagtgaagtatcaaggtcaatgtaccaggagaaaagtagcaataagcctttatgactttcagacaaggaagaaaattgatcaaggacactaatataagaagttacaaattgattttttttttgaggtggaggagtggcacctgcaactttacccagcctctgcctccttctagtttcctggtcctgaatgtgcatgtgtgtgtgtttgtgtgtgtgcacgcatgtgtgtgcatgtgtgtatgcatgtgtgtggtgtatgtgtgtgtgtgcatgcatgtgtgtgtgtggtgtgtgtgtgtgtgtgagtggtgcctgtgcattatgtgtgcacatgtggtatatgtgtgattgtatggtatgtgtgtgtttgtgtgtgtgtgtgtgtgtatgtgcatgacaggaagccagtttgtttatagtaattctctcaccactccatcatttattctcctactcatttgtgttttcaacagatattcaccccattacctattatggtccagggtatgctaggttgttatttatagaagaagatgggttcctgctctggaagaactaacagtctacgtagacagttgaaagagtaacaagtaattgcaatgaaatctaatacttactaaaataaagatgtgagcgaaagtctgtgggattgaaatttaaggggtgacttatgtgaggtcaaaaatatggaatagggtttcatggagaatttggattgtgaactgttctacttgccagataacaaagatcattctaagcaaagggaactagcatgcagaaaggtacggagacatgagaaacatggttttttcaggaatggtaaataaaaagctcaatgtagcataagaattcactttacagagagaggataagaggctggtaaggtggcaaaagactagatagcaaagaggtcttgtttactgaggctgtggacattaaagctcccatactagacccgctagcaggagggagggagacgttccaggtgtactctcactacactttacttttttgggacctttcatattaaatttaaatgatcctaaaaagcaaagaaacaaacacgaaacctcttggggttagctagacttttatttatctggattatctcagtaaaacatattcctaaaattgtcttgtagataaaagtcaagaccaaacagccaagaatggcagagaattggagaccatatgcagaaagcatgtgaatcgaggaggttgcaatcatttcctggtgactccagttctgccacaattgctcaggcagaaatgaggcaggttgaaacatttgtgtgttggtcttagtggtgaagctagtcacttcagctcagccaggtgacagggtccagatggcaaattacaagatcattgaattcagtgcacaagaaggtcctattcactaagagtaaaaatagcttcagaaagatttaaacaaagtcacagatgacagatttctaatgggttattaaaagaacatggaatgtttgaggttacagccttggtctttgaggttggcaacaaaatcaatcattccctgccacaacatcccttgtgaccctgctgccaggcacaggacccagggtggacaggtcttagccctgcacagtggcttaccttgtcttctgtctcccctgtatgaattcactgaataactccttggcctgctatccctgtggctgcatagacacagactattaaacacagactattaaagtctgtgtttgatatttgtttgctaggacaacaaggacaaattggaaattttcacagaagagaattgaaaacaataaacaagggtggaggaggcaagagagattgatttacatgaaaatattagaggaggaaaaacagatttatgtagctactttggaaatgattacgaaagactacaatcatgtttttttgttaaattaaaagtacacccaagggcctctagatacaattttcagaagattacaattaggttaaattcatgcatgtgaggattcccagtaaataatagcctgatttcttattctggcatctcagatacagagggcaacaccaaggagattccccactagagagatataaaatatcactagatttcaatgctgaaggatggagacagagcgatcattcatgagatgggaagtgacctgctgtggaaaatgaacaggtgtttctccaaggtgttagaagctgttgtcaggaatggtcctgcccatcagagtacttcttccttacactgcctgctctggaggcaatgcacttaccatgacatgccaagtaggtgcacacaggcacacacacattcacttactcatacatggcccatgctgccttaatatgtcattctcattgtcccaggtgcatactgtcttcccttctatttctgcaacttcttcctacttctcacccgctcaggagtgactgcttagggaatctatatctttataaggagcaaatgtcccaaaccataggagccagttcccacttgaagccaagaatgaggactgtgttcatcatgactggcctcagctcctctgtcttgctcaaaacatgtccttgacaggaggtgtttttattttgtcctgcctgaaggatgtcattcttaacagttccttagagaccactaaaaagacaaagaccacatctggtggagaggatacctttgcctctgagttctaggatgaggtgagaccagccttcactaattattcaaaaagatccaaaatcaatcctgacttctcctgtccacctaaaactgagcaagaacctcctctcagctgtcatcaaagtgtaaatgcttagaccatcttagggcagtgactggcatgttgagctgtagctgtgattccaagcccaggtcttaggccatgtcttgtttctttgaccagcccaaagtcttttctgaggtgactcaggtggggtcagacagtctgctgtgacataggaaatttctgactctttgcctatttctagctcatcatctggctgttacttctcccatccctttgctggtttccatgtcactgctgtcccgttcaccttcatccgacctctcaaacaagatttgctggccagactatggctgtttctttatctctgggtgccctcgtttcctgccctccagcccagacttcattgtctgtgcccagcttctgtcattgctttgccatccacaaatgggattatcttcccattagctctcttttaattcttcttcctctctctctctttctctctcatcattatcacttattgctaataagggtttccagcatattcattcagcagtttattttattcatcctccttctcctcttcctcctcctccttcttcttctcttcctcctccttcttcttctcttcctcctccttcttctttctctctcttcctccctctcttgctcttcctctccctctctctcttcctctccctcttcctatctcccgctctctcttcctgtctccctctctctcttcctctccctctctctctctcttcctctccctctccctcttcctctctgtcttcctctccacccccccttcctctcctctctctcttcctctctttctctctctcttacttttatcttctcctcttcccctaggagtcaatgaaaatgccactaccttttctcttacgtttttctgtgtccaacagaccaaaggggctcttggaattaaacctaaagttctgtttcttctctctagaggtgccctgctgaaacctgattctagcagaaacattgtcccttaaaaggaaaaaaacaaaaaaacccttccttgggtgagcaggcaggaactgagtgcttgaaagtaaatctccatctaccaggatttcctccacagacagacttaacagaatcgtcccctccagttggcttgggaaactctgcacctccttctcagggattttctcaagcgaaaacatgtaacttgaccgatttttcacaaaacccttgtggtcagtcagctgaatacagtgatacactgttctttgtagaggacatcaggctaagaggacatctctccagcaatggaaggctaaaacccaacccatgcttgctaagacaagccaactctgagagaaggggcacatctgtccagatgggtacttttttctaatttgcacaaaggcctttgatgaactagtgctgaactgtggtcattttgaatgatgccctttgctcccctctcagaggcaattgtaaccttggttactcaggatgataaaagaacaaaatgtgccctaatgagtgactcgtgcatgccggttcatagagcagctacctaagtatcttctgatttcagacgtctacccccagagatttaaatttcacaagtctgggagagggcccagaatctgtacatttgacaagctcccacagatgtttctgaagcacagccagacttaagaacacttcttaagcaagacatggagtctccagacgcctcgagaaggcatccttttatcagttaactttttccaatgaaaataagaatgagcttgtagacaagtggctgagtgcagctttaaagatccttgcattttattaattttttttttgagacggcatttcactcttgttgcccaggctggagtgcaatggtgctatcttggctcacgcaaccttcacctcccaggttcaagggattctcctgcctcagcctcctgagtagctgagattaaggcatgtgccatcacgcccggctcattttgtatttttagtagagacagggtttctccatgttggtcaggctggtcttaaactcctgacctcaggtgatccacccgcctcagcctcccaaagtggctgagattacaagcgtgaaccaccgcacctggcaccttttattaattgggaaagggagagccagagaggtaaagtaacttgcccaaggtcacatagctggtagtcaagcttcatagtaaccgctgggtgttggagacaagtcagttggttaaataaagatttaaaagagagagcaatgtgaagagcatataatactctgaaagtcagggatcagctgtagatgggagatggacagtctatgtttgacagcctgcttctctgcatcccgctttcccaagactgagggatacatcttcatcccacctcctccccgtggtgatgagagtccacctacagtgctgtctacccccagaggaggggggaggctctgtcagctgttgtctctgactagtccagtcacggcaccaagagacttattttaaacagtgccagaggcgggaacactcatatttcctccaacaagtccaacagggtgaaaaaaaatcaacctcaatttaccctctcatctgctcaagaatggaagataaattgtttcaattttatagaaatgaatgttttatgtcttgcctatgctttccagatagtgtcctgcatttgtatattctactgcatgcatgggcattccactaggaatgctccctagactttcatcttgggtttcagtctaaaaatactaggtttcagagtgctattatttttcctggctttggagtttttggctatttatcttttttttttttaatcaatagaaaaaaatacattcattatcccatgtgtagagaaaactgccattacgattttggcatgtttcttcccaatttctgtttctatacatgaaatgcttgctttttactaacccccacctcaattctgtatatatttttgttctctctcataatcacaaaatagggtaacgtataaagaagcattaaaagtatgtttgtgatacattatttttctcaaaactttttccttgagggtgttattcttaatgccaaagttaaaaccttcaattttaagctatttttagaggaaagaagacagcagcccagggcctagcattcaggtgaaactcctttaatataaacatctctgtaagtctgtgtataataagaggttgtaggaacaccatctagcatcctgcacattcaacaccatatttaatgcattacaacttaaatgtcactgaacacttggagtaatccctcacataatgctaattaattgctgtcattaggcagggcacggtggctcacgcttgtaatcccagcgctttgggaggtcaaggcgagtggaacacctgacatcaggagtttgggactagcctggtcaacatggtgaaaccccatctctactaaaaatacagaaaattagctgggcgtggtggcgggtgccatggtggcgggcgcctgtaatcccagcactcacacacatacacatacacaccatggaacactactatacacacacacacattttatatatatgtgtacacacattatatatatgaatatgtattatatatataaaaaacattttctttattcactcatcagttgatgagcacttagattaattccatatctttgcaattgtgaattgtgctatgacaaacatatacatgcaggtgtctttttgatatagtgactagttttcctttggatagatacccaatagtgggattgctggatcaaatgttaggtctacttttaattctttgataaatttccatgctgctttccatagaggttgttacaatttacattcccactagcagtgtataagcattcctttttcaccacatccatgccaacatctgttgttttttgtctttttaataatggccattcttgttggggtaaaatggtatctcattttttaatttacatttccccgatgattaataatgttgagcatttttacatgtttctctggccatttgtattttttttaaatatgtcaattcatgtcctttgcctattttttaatgggatttcttttcttgctgatttatatgaattccttgtagattttggatattagtcctttgcagatgcatgttttgcaaatattttctcccattctgtaggttgtctgtttactcttgattatgaaataagatggttgtttcttttgctgtgcagaagctttttagtttagttaagtaccattgatttgtttttggtttttttgcatttacttttggggtcttagtcataaattatttgcctaggccaatgtccagatggttttccctaggttttctgctagaatttttatggtttcagatcttagatttaagcctttaatccatcttaagttaatttttatgtatggtgagggatagggatcccgtttaattcctctgcatgtggctatccagctttctcagtaccatttattgaatagggtgtcctttccttggtttttgtttttgtgtgttttgtcaaagatcatatggttgtaagtatttggctctatttctgggttctctattctgttcctttggcctgtatatctacttttataccagtaccatgctattttggttatgatagtcttgtataatttgagatcaggtaatatgatgcatcaagatttgttatttttacttaggattgctttggctattcgggcttttgttgttgttgttgttgttccatatgaattttagaattgttttttctaattctgtgaaaaaagttcttgatattttgacagaatttcattgaatctgtaggttgctttgggcagtatggtcattttcatgatattggttcttccaattgatgagcatgggaggtgttcccatttgcttgtgtcttgtatgatttcttttagcagtgttttgtagagttctccctgtagagatctttcacctccttggttaagtattttcctaggtattttttttttgtcgctattgtaaaagagattgagttcttgattttattctcagctgggtcattgttggtttatagcagtgccaataatttgtatacattgtgtaacctagactttactgaattcgtttatcaaatctaggactcttggaggaaattttagggttttctagatataagataatatcatcagcaaacagagagagtttgacttctttttttccaattaatttggatgccctttttttctttgtcttgccagattgctctggataggacttctaatactatgttgaatagaagtggggaaagtgggaatacttgtcttgttccagttcttaggcataatgctttcaacttttcccttttcagtatgatgttggttgtgggttttcctttcttttcttttctttctttcttttttttttttagacagagtcttgctcttgttgcccaggctggagtgcagtggggcaatcttggctcactgcaacctctgcctcgcaagttcaagcgattctcctgcctcagcctcccgagtagctgggagtacaggtacctgccaccatacccagctaattttttgtatttttagtagagacagggtttcaccatgttggtcaggctggtctcgaacttccaacttcaggtaatcctcctgccttggccttccaaggtgctgggattataggcgtgagccactgcacctggcctggctgtgggttttcatatatggcttttattattttgagctatgtttcttctatgcctattttcttcagagtttttatcataaagagttgctgaaattttatcaaattttttctgcatctattgagttgctcatatggcttttgtttttaaatgcagtttgtgggatgaatcacatttattgacttgcatatgttgaacaatttctgcatccctaggatgaaactcattcgactatggtgattttttttttttaatgtgttgttggatttggtttgctagtattttgttggagtttttgcgtctattttcagtaaggatatcggtctgcagtttttgtgtgtgtgtgttatgtcccttcctggctttggcatcaaggtaatactggcttcatagaatgagttagagaggattctcgccttctcagtcttttggaatagtttcagtggaattggttccaattctactttgcatatttggtagaatttggctgtgaatatgtgtgcatctgcccctgggctttttttgtttgtttgttcgttttggccttttttttttattaccgattaatctcactgcttattattggtctgttcagggtttctattccttcttgattcaagctaaaggagttgtatgtcttcgggaatctatttcctctagattttctagtttgtgtgaatagaggtcgaactggatattttaaaaaaaggtgagtaattaattatatttatttcacctacaatttctgcaaaaacaatgctaataaaaataatattaaggtttattcttcctatgccagtacaatggattcttgttcaaacactcatactataatcatttttcctaagttttaaactttatgtaatttcaaaaattaagagcaaacattttgccactgcgtatcttgttttctactttatctattttttttacaaaaggaatgcgtgtgataaaaaatctagaaaaaaacaaaacagcaaaaagaagaaaatccaagccacccaaagtaccatcccctagagagtgctcatactcctggttttatttgtttagctataatacttttgttaacaaaataacattgtattgttctgtctcttgatttgttcatgtgtgtgtgtgtgtgtgtgtgtgtgtgtgtgtgtgtgtgtttgtgtgtaaggcacattttattatttaagggtcggtagtacattgaccagaatcacagttagtgaacagaacggtctgatgccaacatttaggcttttttcattaaaccacaatgaacttcaacaattggggtgactttttccttcctttatggcccttctcaacaagtttattaacctttctgtgtggttttccacactgagactagcattgttattttgaagaaatataggcaacaccagagttgccaattggtgttggcctttagatttaagactcttggatgtcagagggtccctagacttctgtgggtctgtaaatagttgttcaaggccctaagactgcattaactcaattagcactataggtgaaattccctcatggggctgtccagaccacagttctaagcgtggtcttccattgtgacatagaacagactcccttgtgtataaccacaaaagaaggctgactttgaaaggaacaagtgctcaccattgttggatggtcacaagtggaaacatattctacactaggaaaaacctatgaggagttgaattaacatcaatgccagtgagccattgtactttgcatgcctggtattattatagcaccccctacactctgccctgcaggtgtgggagtaaccacctatttcatcttattcaagagattgcatacacctcacttctaagagggttaacgttcacctgctcacatttgtatctttaagagaggcagcagaacgtaatgggaagaacacaaccttggaatcagatggacttggattcaaatctcatttcatcttcttaaaagccctgtgtttttggctagcctcataacctttatgagccttatttcttaaaaatgagaataatagtatctacttcatagatttgttataaagattattttaaaaacctaaatgagatgagttgtgctcaataatattacatgaagtatgtaggtactcaataagtgatggcctgttcacattgatgatgctttgcattggtcacagcctcatttgtgttctttgaactttcaccaaatgatgtcaaccttaatgtcaatttggcatttgagtttagagtaacctacttctagaatgtaaattccatgaaggcagaaacaatgtctcttatgtaaaattgcactgtcataccttaatacactgtctggaacatagtggatgttccagaagtacttgctaaataagaaatgtgtttgtcttcccatggtctttcataagcaatacctaagaataatagtagctaccacctttcaagtattaccaagtctgggggtggtttgggcagaacatccacagacctctgttttctgaacctaattggatctttaaattatctcatggagtggtgaatcacctccctaatttcaggaagtaagagtaggaataccagctgaatcgctgacaattctagacacatagaggtggaagcccacctcaaggtcataatatccaatctgccacccattgtagaaatccctcctacagccatttcatcagatggctgcccaaccactgtttgaacactcttggtaatgtgggctacattatttgaagaggcaactcattccatcattgtaatgcagattcttagacagttctttaggctgagcaaaaatatgttttcctgtaacttgcatttgtttggtcagctccgtcctttggagcaataaagaatatgctgatttcctacttctacgctcaggactgctgccatatatagtacctttgtgtgcattagaaaaatatactcatctactgtaaagtgtgggatagacgtctgtgagcaaataggaccactatatacaggctggctacatgttaatgtctcagataattgtgtataggatgatgtctctgctggctcttctcttctaaatagagcttgttccttcaactattctttagatcataagttttatgagtctcttaaagatcctactagctgtcttttgcatgtccctagtttgtcattatgccttttagactatgttgcccaggactgttcaaatcactatgtaaaatatggcatgcctgtttcttcccctgtattttctattagtgaattctaagctaagcttgtgctaggatctttaagaaaagtcatgacgtttgcttatagtaagtttgtggtcaattaaagatctttcctgcaggaactgttgtcaaaaaggcaaagtgtattcaagactgaagtcaattgtcttcttaacctaggtataggtcttatataaaatcatattaaattttagctttatcccattgaaatcctttgaatcttgactttgtgatcccatgtattagctatcccttcttctttatgtaatttgccaatttaattaacatacattcgtattactccattctcttgctgctgtaaagaaatacctgagcatgggtaatttatacaaaaagaggtttaattgactcacagttccacatggctggggaggcctcaggaatcttataaacatggtggatggcacctctttacagtggcaggagagagaataagtgccagcaggggaaatgccagacacataaaaccatcaaatcttgtgagaacccactcactatcccgagaacaatatggggaaactgcccccatgattcaattacctcccaccgggtccctccccatactgacatgtgtgtattttgggaattacaagatgacattttgggtggggacacagccaaaccatatcaccttcagtcacctcgaagtcactgacaaaattgttaaagaaagcaagatcaagccctgcttcacttagagatcttcctgaaggttgaacttaaccccttactcaaaacttcttggctatgcttgttcaattccacatgaattcatcaagtatactgatgatcattgaacatatttccatctagtccatttcaaagatttcatcctgtctggaccagaaggggcatttaatacattttctaaaccagttagtgcatgcttttctaaaaatcaaagatgacatcagtgccaacctggagaagtctccataaatggccatggccctagcttgggattttgtcttgttagtgaatcgattgtagctcctagacatctttggattctttattgttttaaagaattgatccatcctctttctctggagaaggcaaagctgttgagattttgcctccacagtctccatgtgtctcttaggccttgtctttctctaagccatgtagttttatgtcatttagagtcttgctttaaaaggagttctgatggcaggaccctcaatagttttttatttgataagtgaaggtgaagacaataataataggtaataatttactgtcagtttactctgtgcctagcacacttctaagagttctacatattttaatctaaccacaactatgtgaggctatcccctctttataggtaggaaactaaggcacaaggaagtttggtaccttgcccaaaggttacacccatagaaagtggcatcatttgggattcaagcctaggcattctgactggagtccatgcactaaaaccgtcacggtgccgcctggcacagaaggcagtacactctatggataagcagttttgtgggtgacaagaggcccccattttatgtcttgctctccctctcacatcctcctttgaaatgcggggtaatgtgagtcagacagctgagctcactgtgtgcacagcggtcgggtgggtgaagttccctctagaggattgccctccacctggtgttctgatttttcttctttgagaggttgtgtaatgatcttctctccactgtcagtgacttaatgagctccccacccccacctctccacccaggtcccaggagattttgcccttggaaagaagcccgaagataagtagagcttaccccaggggaatgaacttgttcaggcatcagtgaagtccatttggaaaaatatttggggtgcctcatggtctgtataagagcgggagggagatgaatataccataagcttcttttatgagtcagacactcttctgggtgctttaaatttgttgcctcatttacataatactaggtaatatttattgagtgctttccatgtgacaagcattatttgtaaatgctttatgagtattcatattatttgctcctcacattttacagatgaggaagctgtggtacagaggggtgcaataactggcttgagagtcacagtaggaataaaaggagatagagtgaccctaatagtctggctccaaatcctggctttcagcatgatgtatgaagacaagtatggcaaccatgtgagctattaggatagactccttctggcactcaagactcctagcaagacagacccagcatttgtttcaaagcccgattgaactgcttgttcttgatcacacttgccttttactttaccccctccccacttttgctcaggtcatttatttccctccagttccttccctttaataccctacctggttaattctgttcattctccaagacccagcccaaatacctgctccatcataaagccttttctaactccccaattggaagccctctcttcctcctttgggatgcctcaggcctgtgactatctattgtggcaatcgtcccagcgtgccttgtcttatttctatcccttgtcttgacctgtgctagaccataactttggagcaagggcttatttttgagtctcattctcaagtacatatagtaggtgctcaataaaaatagaataattgctactggtgagatttctagtgtcatgagaaatggactcacagggacacatcacatcacctcctctgtgatgtgatgtgtcctcctcggaggatatcctcacaggatatcctcacaacccatcacctcctctgaggatatcctctgtgtcagacaccctatttgatcctcacaatagtcctctagggtcttatccatttttgagatgcgaaacttgaatctgaagggaaccaagccagcagaacacaagggttaaaactctataagaagaccacctgggtccaaatcctggctgtacctcttactaactactcactttgctgggaacaaattacataagttctctgtgccttaacatcctcccctgtgaactagggatcacaatagtacctgcttcattggattgcagtgaggagtaaacaaaagaattatggaaagtgagagtgcctggcttgtggagtgtgcttggtaataccaggtggcaatgcaatcagatgattatttctgtaagaatcaagaaattcagcatcatgcattgtaacccctgtcagggaattggttttcaggagggaagtcctgcatgcattatttaaaacctttcagctgaccactggccaacagtccctgggtaggctgttttttgtttgaattggtttggttttaacttttctcgttttctctgtctgcatcaaatacacacttctgctcttctaaagctttgtgtctcccttcctcaaattgcattttccatggggcaggggagggtggtattggacacactaacctgaactccagcctcttgcctaattacactgcagtcagattttccatgggagcccctagcgtggcaggatgccctctttgaagtcattagtcttcacagcagggagagcacatcatcaaagactctgtttcccagcaacccctgatgtgcccttgtgcaccagaggattgcagagggaggaagaggcaaacctacacgtgtattaagtctgctgttctctcctctggccctgaactgcaattcctttgaactgaagcccagagagagggctggtgatgctatcgcaaaacctctccccattctttcagtcttcaaccaatttagcaattaaacttcctagggccagcagtacagaatgtagggcatagtgaggttacagttggtaatctaaggcgccatgggatgggggttgggaagggaaagaaactgcctgggaagttctggatatatacttgataattactgtgaggaatctgctataaagttagaaatctctttctctttctctgtctctgtctctctctctctctctgtgtgtgtgtgtgtgtgtgtgagagagagagagagagagagagagagaggatatatgactctgtctcttacttgccatttaccttgggaactggggagcctccttttgtcctgactttcagtttcttggtccctttgaagctctgtggctattgtgaatgaaataatttttaacaaagccattacttagacccagattttaaatttctgcgtgaacctaggtttttgatgccagcactgaagtccaaggaccagactaacctaacctgttctatttttggaaggccagttggtggagttctattatggaattcttaagttgggggacagcattgaatccagatctcaggggcccttgccagggtccagcatggagcatctcctcttcatcactgcaacatttgcccttacacatgtacacagactcacctgccatcaccactgctcttgggctggcattttatctctcacttctaccaccatgatggtcttctcatctggcttcctgccccctgatttatccccaagtccttcctctctagccaccaaaagatctatctaaaatttatgtccattttaccctctgccccaatccaccaatgacccatatggccctacagaaaataaatttggagtttcctaaggtgaactacaagtgcttcctgacctggttcctgccaaccctctctgccccatctccaatccctccctgcctgaaattttatgttgcaatgacattgaatctcttgcagagcccttgtgtgtgccgtgctatcctacatttcagtgcatttgctcaggagtgtgctgtgcctagaatggcttttcctactctgctccctctgccatcccaggcttatctgattactttctacttactgttaaaatctgcatgcagatagtctcatctgagatacccatctgatgctatcgagtcttaataaagtggccctcttctgtgatcctgtgacatccttgcatatctctgccattgtattcaaactgtgattataatgatctgataactataatcatctgttcactggtctgcccctgcccatactatcccaagctgcaagttcagggctgtgtcttatttatctttgtaaccctatgtcatttcctgtcacattcattattaagcactgaataaatgttcattgaatgaatcagcgaatggttgcatataaggttatgtgtgcaagttctatcaaatctctgcttgactttctcagtgcattccccagtgcttaggtctctcaatccacaaaagagaaatcagatttttatatttaacatttggcatggtgttctttactgaggtaaatcatctgtgttccacctactactgtagtagaatacatccatcatttattcatttaataaacatttattgatgactttctgtgtctcagggattgtgttaggtacctggaaaaaaaagatgagtaataatagccaacaatcatttagggcttattacatgctacacactgttcaaagcatctagtattaacccatttaatcttcactacaaccttatgaatatgaactatcattatccatctccactttataggtgaagaaattgaagcacaaaggccgttttagctgaagtaccctagaaacaaaggttatagctaatgatttataagaaggcaaaatccttgacagggcaaggtggctcacacctgtaatcccagcactttgggaggccaaggcaggcgaatcacttgagatcaggagttcgagaccagcctggccaacatgatgaaaccctatctctactaaaaatgctaaaattagccagtgtggtggcacaagcctgtagttccaactacttgggaggttgaggcaggagaatctcttgagcctggcgaggttgcagtgagctgagatcatgctactgcactccagtctgggaaacagctcaaaaaaaaaagtataattccaagtcagcaagagtgaggggaaaagataattgagacaggaaagaggaaaagtaaatgcagggtgttgcattaggaagctgaccatagctttacaagaagactgtttgagatccacaggacgtactataaacaggccttacagcaacttttaccactaaacagtccatagaaagtgaaggttagggaggaagggagaggaatttacctgctattttctttccagtctcttagttctcattggtgggtggcggggggggtggggtgaaaactttcaagtacttccataatatcagaatgaacgaagcggaggctattcaccacattcacacacacacacacacgtacacacacagttctcacatctaaatgagtcactgatatggatcaacctcaattgaggaagtgaggaatctccatcggaactataatgaaaaattcacatttgacatagatcaatgtataaagtgcagaaagtgtaggctacaagagagtcaaatataagaaagttgaaagctgactgttaatgtctactgaatgaatgagtgaatgaatgaatgagttgggatgaataaatgaatgaggagggagcatcctaaagagagatttagatatacatagtagaagaaaatagaatagtcctgaaattaccccatagattaccagagtactaatgcgtatggggcaatgagtatctcaatggcaaaatgacaagctaatagagtctccactgacattgattaggtgactcaagtgtctattagcgagatgaatgcagctagactttatagcaggtgtttttctgaaaggaggatgttcttgggagagatactagatttgtagaggtaagggagttgagggattaaggataaatgtcttcctgctcccatttgactctaactcctattccagaaagccttcccagaacacttgcttctgttctcatccttgtttttgctgtcacaatttaaaagattctccctggagttccatagcacccacatatagccaaataagaaaattcaagacagtataactattggtgttctgtctgttttcccacttgactgtaaactccttaaggacatggactataccttctctggctttgtgtttgtgataccttactctctaagtcatacagtagctgtttgtagtagtcagctcagcctgcccataacaaaataccatagactgagtggcttaaacaacagacattatgttctcacagctttggaggcaggaagtcgagatcagggcactagcactgctgggttcttttgagggttctcttcctggtttgcagatggcagccttcttgccaggttcctacatggcagagagggagctctggcgttgtctattcctcttctcgtaacgaagccaatcctattggattagagctctgctcttataacctgattatccataatgacatttttaaaggccctagcttctatagagtcacatggggacttgggtcttcaacataggaatttgggtggagtttcgggggtgacaattcaacccacagcactgttcaataaacactaaatcaatgatagaatcaatgaccaaatagtgctacatgattgatgggtccactggagtcactttctgagagggaagagtaatgaatttttcttgcccttttgagtctctgtgtactcctgtattctccaccaagtaatagctaatgagagattttgcaataaaaatcatcttagaagagatgccaagtcgttttggaaagaaaggaagggagacaagagcttcttttgctatttcagtttagacttgagaatgctttctaatcctcatctagcttgcttcttcacgtcagtggatacaagggcccaattgggggtgcttaatgagtttagaagcagaattctcattgtctctcaactcatttttttttacaacgttcaaggcaaatttttttttttttcttaagggcaggatccaacccagaaggtcacttcaatattcgctcatctcctccagacttgaattaacactgtggagaagtaaatgaatccagataaataacttcaatttatttatttaggtcctgtgttggatgccagggaaatgttcctattggtagcagaaatagctgccatttgttgggtccctgctttttgcttaccaagaactttacttacactttatttccatggttcccaactctgcattgagggacttgggggatggcagcaatcttacaggggcactgtgagatattttgaattgtcaacagaaatggcaatatcagtcagataccatactaacgactttgaatttgtacttattgtattttttctattatctactaatacattttcagatgtaaagacttattacattgttcagacataactatttaatacataaaactagtagatacttattttggcctaggggagctgtgaaaattagtgagtcactttgaatactatgatccaagaagtttgagaacctctctttgtctaatgccctcaataagattgacatcattttctgaagtttacctctgaggataccaaggaccagagggtcaaatgaatgactacatggttaaatggcttgtaagtggtggagccaagatttgaacccaagatagtcagtctctgaaacctattcttctaaaatgttgcccttctgcaggattatgaagattagatcttagactgtcagagccaaagcaggcttcagcagtaatccagcccggctcacaatctagcccggtcacacagctagttagtgttcgaattatcgagcgatcaggtcgcctggctcctggttctacatcacttcatctccgttttaattctctttctttccagctttggacagccactcattatggctctatagcgtttctttttgttttgttgttggttttttttttttttttttttttggtttttttttttttttttttttgagacagagtttagcgtttgttgcccaggctggagtgcaatggcatgatctcggctcactgcaaccttcgcctcccaggttcaagcgattctcctgcctcagcctcctgagtagctgggattacagtcatgtgccaccatgccaggctacttttgtatttttagtagagacggggtttctccatgttggccaggctggtcttgaacttgaacttcctacctcaggtgatctgcctgcctcagcctcccacagtgctgggattacaggcatgagccactgcacccggccggctctataatttttatggttaagtgttgaagatgttttattaactgaagtacagagaaatgagggactttggggaagagcagcgaggctaattatgagggcaaagggattggcttacagggagagatgaaaagaacaaacatgcaatgtataatttggattaaacatacttaaatgagatgtggccatcatctttaatatctaaatgataaaaagtcatagaccagggaagagaggttgtttagagaatatagccaggaagtgggataagaagaagaaagaaacgtttaggctgataatgtgatgttgatatttattagatgggcgtgagaaggatggggacagtggaaggctttccttgcctgatttatgtaaagttggattggagaaagcaccctgggaaatatctggggggagactacgccagtctctggggggattacctaggttctcctatttgtgatttttagagtcctttaacagccatattttctctttcatcttctactgtgttacttaccctttccattattttcacttcctgctcatttatatccagccagcctcttccttcctttttccccctcttacttccttttgcccccactgcctcacactcgttcttgatttctttttttctctacttattctcccccattctcatcttcctccttgtcttcctctagtacctggtatattccaggtttccaggccattgcacttcttccttcttcttccaaaatagaagatgaattttgccactctgacaaagagaacaaaagctaaaagtccctgccaaagttacaaggacagcattttctctttttaggggttttaattttaaaaggaaaaaaaaaatccagcctcttctccccacccacccccccacccctgctgtgctttcactgctttctgggctgtgaacatcagttgagggacagccagataaaaagccgctccttggttcagatcatctcaggctctcatgttccctcccatcctcagcaatgctcctttttactgcatttgttggaaatccaggctgaaaatggtagtattagcatttttaataaaggacactggagaaaagacaggcagtccaagaaagctgaaggaggggagggaacccaaatccactgagagtcagaactcccttttggagccagaaagagctcaagatgggggcagggggagggcggacaagagtagtagtcttataagaagcattcaggctggataattggagctttgagcacaagcagaaacagttgggaggtgggaaattgctgtgctggattgagtttggctcaacttgatactgaagctcaacattatgaaatgttttctaatttagcccattttctctgtcttcctggaatgagccattattcgtccattatcagcaaaatgtcatggccctgccggaccccttcttttcttttattttctcttctcttcttcgtcttctctctgagctctgtaggaagggagaataactaaagaaataaagctctataggaagggagaagaaataaagggagccccacatactcttcatttaaaaaaagaaagtgaacctctgggacctgaagtggctgacatcatttttccctattttgtttttctagggatacgaatgcaaaagtttaatggagttgccaggtttatgttttgtttgttaggccattgtacctctgcaggacgaagcttaattggctcttttcctatcactgaaaagaagaaaaaatatctccttgcagaggttactgttctctaaagaaaatggcagtgattagatctaatgcctttgacagctggataaaaagttgctaaataagaataaattgaatgcctaaacctggagtcagtcacaagttatcacaaatcccaaacaccaaaatgaatcatcctgtcagaattctttccccatcacacttataatcacatgtgagtaacacagtggcaaatctactttacttccccgaatccaattttatagagatctagggctaagtcaaagttgggaaatgcccctttttactcctgggtttcagcctattaattacttaagacctctccatttgtgaagtatcaacctggataattgtcaacagttcataaatttagacttgatactaattccattgtttaaagcctttcaattttaacaaatgggtgacaattgcagcccaatattccttatacttacaatcaatcattttagcctcatctgaatagacaggaggtgtatatatgtagaaacattaaattatatctaggctatgcatcttaatgctgaatcttggtttccttcattagtgagttatttctctttcccctgtacttatagccatgacctggtaccagatgccaggcatatgaatacacataaaattattaaacacagctctgaaaagtttccaagatctttaaaccaaaatccctttgaagagtggagaaaggcaaatgggtttgtatttcttagtttctttcaaggaataaatgctgcctccgagcttcatattcaagggtagaattaacatcagttggagactctcaaacacatttatgtttggatagaatgtaggtttagacccagagccaagttcttttgaaggagtcagaaactcatttggaaattgctttgttactataactagggataagagttcattttttcctcatgtctattaatttgcaaataacccaaagtgagaccttggccttcagcttttctcataataaaactgtcctggacaaagttcaaacatttggggatctaaaaggaaaggttttttttttttttttcccaatatatcctctgcaatttctacctcttcctggagttttggcagggtcctttgttcccttctttagtagacaacacatttcccctgggtgacctccccatctcccagatctctatgattatgttgccaaatttttatctccagtcctaatctcttttctgggtttcagggctccattttcaactacctcttggatatttgttcatgaatttccttcaagtatctcaaattaacttgttcaaaattgaacatgagacctgttcccaccctgatgcctgctctaactcccatcattcttgacctgtataaatagcatcaatagccactccattttccagatgagaaactttggggttattctccataattgcccccaaattaccctatcctctgtccagagttcacacatatcctgttagttgccaaatcctctttgttcacctcagatgtgtctctcaaacctagctgcttcttgctattcccaaagctattcttactctaggacaatccattgcctttaaaatttgataacatcttcctaactgctctcactgccattaggcacatctgttgaaatgaaagatggaagggaagaaaagaaagaaagagcctgggaattaattggaagatatgcctgataggaaagttaccatgagcagagtacaaggggagaagaagaaatgcacatagcttattcagggaatagtgggcatgacagggcaatggatcctgacaggagaggcagagagggtgagggtagaaatataggcagtggccagaaggctttgaacttcaaatgagaagcttggattttacctagtaggaaatgggaagctatagagtatattttaagcaggagaggggatgatgaatacggtattataggaaagcacaggaggcattagatcagggttctgctaactactgccctcaggtcaaatatgacctgtcacctgtttttgtaaataaagttctattggaacacagtgatacctgttcatatatatattggccatggctgcttttgtgctacagcagcagagttatgtagttgcaacagagactgtttggcttgcaatgccaaaaatatttattgtctggccacttaccaaaaaagtatcatgattcctgcattagatcagggtttctcaacctcagcactatggacatttggggttggtaattgcttgttgtgagaggctgtcctgtgccttataggtgtttggcagtgtccctgactccctcaactgtgtacatgtagcaccccaccctccagttgtaacaaccagaagtgtctccagatattgcctagttaagaggggggtcaaaatccacgcttgcccccattgtaaaccactgcatttgattatagtgagattagctcatttaggggacagttgcaacaggtgatgatgagaataataacaacaggtacttatatagtacttaacatgtgcctgccactataagcagttaacacgtgttaattcttttcatctttttaagaattctataaggtgactattattttcttattagtatccaataaggtgaatggcattattatcgttgttctacatgggaggaaatgagacacagagagaagatttacttaagatttctcagctcataagtgtcaaattcaggctttgaactcagatcatctggctcctgaattcacatgcttaaccgtgagactatactgagtgacaagaaaaaggaactgctatgtcttggtggcttaatgaatatgagagtagtaaaaaatagacattttgagttatctccttccccccacttccaaatcacttttacttccctttaaacacaaacacccacataatcttttcatatccctttgtacctgtaaggtgttacatccaactaccctcatactccttagccacatgtacctccttgcagaaatgtacgtcaatctggcataatgcacctgtattttggatgctcaagatggttgcttttctcttgatgttaataatcattacctctctgcaacatttttaaagtagtgatttcttattcccacctctggagtgatcagaaccccttttctgcagttatttcttatttagacctagcaatagctctgtcatcttcctggtttttctgtccacaaagagtgcaaatgttgtgaagagaaatgggctgaagatgagtctaaaaaaatgaagtaagctggaagatgtccataaagggagacaatgcttctagggacaaaagagcaggctggagaagcagcttcagaggcgggcgcaggaggcagttctcagctgcgccctctggaagcctgtcatccagttcaccctgctcaccggccacctgagtgtatcagggtttcagcctgaatgctggtgctggccacctcagaaaataccctagatgggaggaaaaggctgtctgtgtgtgtgtgtgtgtgtgtgtgtgtgtgtgtgtgtgtgtgtgtgtgtgtagagagagagagagagagaaccaataaaatagctaggactaaagatgacagtttgaaaataaaataaaaatcctacttaatggagaacagggttcaatacctatacctcagaaggacaggatggagtggtcaatgcctgtccaggtagaggggcttttagcatctgggactggagctttgggcagaggaatgaggtgcagcgagggatctgcacccacagacccacttccttggctttgagctggtaccagggagccaccaggtagcagcaaacagcaaaggggaataatgaaagcagaaccctgccattcaggcactctgatccacttgatttagcctggagtctttgtttgattggctccattttttttaagttgcaaagagtgtgaggggtgcagtgacagccaagagcagggacaaagaacagaagaagctccaaaaaccttgaggactcgtaagaggggagacaagcgggggagagaggagaggagagtgtcaatgcatgggcagtggggcagtgctgggggaggactcaaagaccacagaggtgcgggtggagactgagtcctgcacaggtcaatggagaagaaactctgggtcttcctcactgataattccttggcataggaaaagacttttcatgttatctacgctttgttttacccctggcagatgaaagtgacagagggccttcagtgcacacggaacaggtgacttctccccacaaggcagactggtattcggagggtaaaagtccctgcatttgaagaagaagagaacttatgggacatgaaggcacaaagttgctttcccaccactgcttagaagctgggcttgagtcctgtggggagggagagctttgtgggtacaggtagtagctcatagttgctctatggcatgttggtctgatcactcagagttcaaggtttaagtccaggcagttcagtgacaactggagaacattcaggcaagtgtgagcagagatggctcagtcatttggcaggaatgagtaaagcaccaggggatgtttattatggacaagaaatgaagggaggacatgctaataactatagcaaggaagttatgcttgccctgttttgtcgcagaaaggcagactggaaaataagaagtataagttagagagaagcagattttagctcaaatcagaaaaacattgattgcttatcaccatttcaaaatagaatggtcttccctagaagaagaaatgtggggactgaggctcatgactgttcggtggacacatggcagtaggtttgcagtgaggttgtagccactaagtcctttgattttataatctcctccagtctagtctttccctggaggctgtagtcatctcaacagcatttccacaagcaaaagggtccagcctgtgagctttcagtgcgatggcaacctcactaccttacaaggcactgatttttgtttttagatggttctaatggaggtaaagtccttccacttcctttttcccagaataatgcttaccatcccccatcacttaaaattggagaaagaggaaatcaaaagccatgtactgcagaatggcactttccaacactccattcttcttgctgtctgtactgaacaattactgaacctcagcgttttgttgctgcctgctgcaccagcggtgtggagagagaataaaggccccatcttgcagaatgctaagaggcccaagaaattgcaaagcattcacggtatcgatgaggtatggaggacagcctccactgctgtctctttctcttccttgcctctggctgggctgttacaatcactggacttcctgaagtctcctcttgcagtcggcttgacagaatggattaggctctggctggatcattctacagcagcacaattaaacagtggcaggcccagcatctgtcatttgtatgagtggattgaggctggtgggagatgcatgaggatcagccatgggaatcagaaatcttttgttagtgcagaggcctgaggctgcccaaccactgtgcccaagtccaaggtcagcgcgaatacattctaggcttgagagagagaaagaggctggtatgcacagtacaggggcactgagatgcaaaaagcagaaaacattttgagctgatgagtgagttgccttcagcaaaaaaatggcccacgcaaggaaacatcctcacaccccaaatcagaacaagtttgggaagagaacagaaaacaaccctgtgaattttaactatgtctgtgaatattttccctaggaaagataagggaagtgagtgcagaatgagttaatgctgccaaaaggattaagtggaataaaaatggtgtttacaaatataccagggaaaagaagcatttggggaaaatatgtccataaataagtaaagaggattgaaatctactgcgagtctaacaagaccaaggtgctgaattgctttttcctatctgtcttttacgtggaaaataacaagaaaattgagaaacttgtgataattttcagggggaggctgtggctgcgaggcagggaagggagtccagtgggagtgctggagacagtgtggagagatctccaggggcttgtcatgactccctagatggcccagatcaacctgccaacctgtccagcctcatcccaggcctctgccttccacgacccttgtgcatctgccacattgaaccacttacattatccaaacaaaccatgttctcacacattcttcagctctccccttcctggactggaccctccctctttgatcattgaatttcacccaccccaacatcatagctgctctcctactcatgtgcatacctggaaacatcagaccttttctgtcttccagtgtccttttgcaaatcccccctcaatcatcatctgtggatttccctgcctcctcttagtttcacactgcccttttccatccctctattccttaccttccttaccttacataaacatgtgcagacatataattgtccctgctagaccatgaactcctgaaggctcacgctaggtcttttcactctgtgttcctgggttgtctatcacagggtcaggcacaaagtaaagcaattgttctctctctatgctgcacattagaatctctttgggtacgttaaaacatacccatggccatgccccatatcagacatactaaatcagaaatttctgaaggtcaaaagttctccaggtgattctggtgcccagtgatagtatggctgttcttaaggtctgattcacagtccagcagcatggcatcaccggagaacttgttagatcaggtgagataaagcacgttcagggtggtaggttgtagacccgagaacctgtcataaatgcaaattctccagcccaccccagacctactgaatcagacattcttgaggtggggcccagaaattcacattttaataagccctccaggtgatgcacgccgaggtttgcgaatggctgctctagcaaaggcgtccaataagccatccctgaattggaccataaaggcattcccttcatcctgagttaccggcccctcggtttgcatagccctcattacttcccaggataaatgcagttgctaaggccatggctttggaatctgattctctgtcttccccctatttctttcccacaggaatcaattaataacaaaccctataactcacaggacttttcttcaggttggccagtcccctggagaaggaaatttgcagagacacagcctcctgcttattctgcagctggaagctttgggcacatttagttgtaaaagcccctttactgactgaattctgcatgcttaagactcttctgtcttcctgctgacctccccttccagttagttacctcctgttgacttcgcaagcctttttttatttggcacaatgtaacaggcaccaatcttcacctctttgcctctcatgaagctaattcctacccagcataacaatccaaaacttgataacatttctcatatagaaatgttatcttcacttcaaatttgatacatacattaactatgctgcctcattaaaacgactgaaactcttagttcaaatgttttcctcccttccctagcacagtgaactgaatagagccaccaccacctggtattcaagccgaactatgagaatcatgccagactcctctctctccttcatcgtcacatccaatcaatcaccacatcatgattgctctactccctcaatatcacttggagctctccagctctgattgctacaggcattccttggcttggagatgcatcacttcagtctctgcctccgtcttcttgtggcattctccctgtgtgtgtctgtgtctcacgtggccatcctcttaaaaggacaccagtcatattggattttggcaccccctactccaggctgacctcatcttaactaattacacctgcaaagaccctatttccaaataaggtaacattttgaagtactaggggttagaatttcaacatatctttttggggggacaaaattcaactcatgttgccagctgtaataatcatctgcttacttgtttctttccttaagctgtaggtcctgaaggagagttaccatatcttatttgacttcatttcctttgtgcttccttttttttttttttttttttttttttttttgagacagagtctccttctgtcacccaggctggagttgagtggtgcaatcttggctcactgcagtctctgcctcctgagttcaagtgattctcctgcctcagcctccctagtagctgggattacaggcacctggtaccacgcccagctaatttttgtatttttagtagaaatggggtttcaccatgttggccaggctggtctcaaactcctgagctcaggtgatccacccaccacagcctcccaaagtgctgagattacagatgtgagccagcgttcccagcctatttccttggtgcttactgtggtatctggcgcataataaaccctcagtaattgtttgctgattgaatgaaaggagaagcatacatgttaattacccttctaacagatttctcagtttttcaatatcttcaaattcttctttattttaggtagttaccaaggctgtcatgttcctaaaagcatcccaccttttagcatttgaacctgaagtttcctagtctctcagcttctccttgccccattccatcccacccaaaactcctctctttgatcttatttcccagtgtcatcaagtccattggcacatttctggcttcatttcctccccactcaacctagatctcacctcgaaatccctgtcccttttattttctgccaccctgcctggcccaacctcagccttgcattggttttctgtgtgtgtctctgctgctctggagcttcctagagtttgggagagtctcatagaaacgggctgtgggtaggcattctgtaaaaccagccatggactccagcagcatcgaactcttcttactcatttcttgtcatgtgccaaaaacctgtccactgtcctcaggcctcagctctttcccagaccctccctgtcagcctcaaacctcagatctaacttagtgaaatgggaacctggctccctcaccttcctgtcatcttactccctgtcacctctcctcttgttcaccccctctcactcctttctttgaagtggatgtgttctcatgtcacagctaaattctccaccctaaattgttgtttcaactcctcaatttctccaatctttgccccccagtcagccacttcttgcttttatggtcatacctacacatcctctatcccttattcaaatgtcaagtgatcccttgaccctttaacgctccacatggtttttctcagttattttcactgcctgtacttcctaagaaaaatacatacacttattgtctttaattttgtcaccagttaatttcttaaagattgttgatgctggtgttataattattaccttgaaagtttagactcaatttggcaatctctccctctcttcctcttcctcttttcatctttcttacacacacaaactctcatacacacacatacaaacagcacactcatggaaatttttctaatatcacactaatatcacacacttctgctaacttataatcaccagaatcattcattaaacagtttggctttgtttttttgttttgttttgttttgttttcctgagggctttgctgtgttttgaactctgccgcatgctgctaatacagtgacaagaaggctcacagggtccctgccctcgagggactaacgctctggcaagggagtcactgaaacaaacaactaaataaatacatcacaagtacttacagattgtgaaaaatacaagggggtaaaaagacagggaggagtggactaacctgaaatgggggaaccggggcctctctgaggcagtgtgtttaagttgacactgaaagatgagaaaggaccaaccaggtcagaagggagggaaagagctttccaggcctagggcaccctggatggccctggaatgggagaaagccaggccccttctagggactgtcagccaccattgctcttatcatcatagatgatagccaccattgctacatcatcataacagggagagagaggcaatgggcaaggttggtgtggtaggcaagggctagagcatgcaggagtcttgatgaccagggtgaggatttaaagcatggaagttccatgatccccctatagcccagggcttaacccttactttctcagagaggctccccttcaccatacatgctccaggactgtttcccttcttcagagcactttcctcaacgtgtggttatatattcacgaactccctttaacagacccccatcagttttgcttctgttcacctctgtatccccagagtacagagcttggccatgccagctgctgaatgcatattttctgaacaaatgagtgaatatttcctcatttctcttaggtatgatttttggcaattcagcctctctgagcctcagtgagtttatctatacaataggaatattaagtgatcagtcactggacttgcttttactgtcttctgtttctgtgtcctttatgttgactcccagtctttatctttgtacttgcctctcttctaaatgtcagctctgcttagctagctacctgccgcacaccttgccagacgttcacagataacactcagccttttcagttcaaccttatcatttcttgccccactagaccctccccttacccccacacacataaaatcatcctctggaactacttgtttctattcatggcaaaatcattctcctagtccttctagctcaaaactctgaggccatcttacactatttcctcttcctcgaccactgcttaaaatatcttccaagaaattctgcctaagaattgcccttctcttccaaatccacgtcttcccactgaattcagatcctaagtactcattttaccttgattgcaaaaggcttctctactggttcctctccctctgggtttctctttcccatttatcttgctttcacagaagcaaaatcttggtgctatcttcctgtattcaaagcccatcagtggctccccattcgctacccaagtatagatttgctttcaggtaccatcatgttatggctttaatttattttttccatccctgtgtatcccacatttcagatgaactggtacctttgctgtttgtaatgttccatcacatccacccacctccatgcctttggtcatactattatttctgcagcaaacctcccttccttctgcaccttcaatgcctagactcagtgcatccttcgaagcttaaagcttatctaaaatagctcttcctgactgagccttttccatgacccttgaacaggatgtgatttcttcttcctctgaacccactcactcccatttcacttgcgatctcttccaccctgcctggaaatgaggatgtcaccccaagtcattagccttcagccagtgcagcccagtgactctccttagttcttctgcaggagtgggtactgataactcacagacgtctttgccagggttctggtgtctgagagctctgggcttgagccctggctctgctgcttgttagctatgagactttggcttatgttatttaatttctctaggcctcactttccccacctgttaaataagactaatataacagctgtgcctcagagggtcttatgagaattaagtgaaaaaaagtacttggctcactgactagtataaatgcataaaaagtaatagcttttacttgttcaatcatcaaaattgacaaaataaatgccatagtttctctacttgccatccttgtttcatcggctcctgatccaggacaaggacccggccttttatctgtgtagcccagtgctctccatagcacctgtctcatcagaggtgagtgataaacacttgaggaatgaatcagtgcgttaatgacattcttcatagcagaaaatgtgtattaatcatttctgtgtcccttgactgtatttagccaaatgtttttttatatggaaactggataatattttttaagtaaacagataaatgaagaaatgaatgagtgattgaattaatagtgaaacttgctaaatatatgttgaatttaaacagattagtagatagaaaaagactttgggaaaaggataaaagctctatactaaatatagttccttaatggatattttattcttccccggtttccttattttgtcaatttttcctgacataaaatcacagaaatgtaggaagctatgttttctattgtacatcctgtcccttattattcactgtctcttgtgctagtactgttcattctcctaccttgtcactggaatttaatgtgagcgtctgtggtggaggaggaggccccaggtttgcaccgtacttagtacagggatgtaacattcagtcgtgaatatgtgttaaactgtttttcttgtacagggatggatttgcacaggtccattgccaagctcttgtcctgttcatttgtgagcaaagatgggtgtccggggacacatggcagactgtgcccattgacgggagtaagcgagctgaacaagctttcaggaccactgaacttgagaccttggctatatgagcccagggtaaaagtcaactgagccttgagatgcagaaccagagagaagtggagggaggaagacagtagttactattatcaccattttacagaaaaaggaaactgaagcttggaaaggtcaaatatctttagctgtatcagttgcatgaagttagcaagagacttgaatccagaacttggacttgaatggagatctatctgacttcagagctaacccacaaaaccccagccatggtgagactgtcttggggtgatttgtatgggagactgcagggtcagtgttggtcagcgacggaccctgctctcagcatgctctttctgcctgactgctttcagtgtctgcagcagctgctagcagggtgagagaggaggaagagagcagtcgtgagtctcaccagccatctgactccctacccacaaagaaaatgctgcagctgtgacatgtgtgtttgtcagtgtgtgtcacatgtgcacgaccacatgtgtgtatgtgtgcataggtgggggcatctgtacctgtagatgcatttctgaatgtaggaaaatctcaatgctgcatagtactgttttcatggaactgttgatcctcagaaatagaaatgattgacagtttttcaaaaatgaatatgcatctcatataattgtaatgagatttgggatatcttaattcatcaataaaggggacaggaaggaa

SEQ ID NO: 218 - DNA, 11839 bp, Homo sapiens
gaactcaatggcaacaacatcactcggatccataagaatgactttgcggggctcaagcagctgcgggtgctgtgagtatggggtgctccctcccaccccacccctggcaatgccacggcagtcctgggcagggccctggctgtgggtggtagggtggtgggctgtctgggcccctctaccacggagtcagtcttggcaagacatcctgaggggtgtcgggtggggtgatgttgagtcttgagtcttaactcatcataaggtccgtcgccctgtgctctcagggtagtgcaggggtcttaggacctcagttctttcagaactcccacctctgcagttctgagggtctttggaggagcagggacctcgtgaccaatcgtctctgaggtcagagctgacaagccgctgggcacggatctgctccagaaacccccaacctctgccgcttcccaggctctgggtgtgtcccttctgagtctggggaggcccatgctctctcccaggattcccctcccctctgcccccaggcctccagcgggagcctctcacacttcaggcttttggaaacaaagcagagaaagagaaatatctggtggcggttcccccccctgccctgcccccaacgtcatctgaggcccatgcaggggcacgaaagccacctgcttgcgggtggagagggacagatgcagggggaaaaacacacttgactatctcaaaagttatcacgcaacagtcaatctgttggtgaaaaatgctgccccaccagccggatgctctgggtttcagggcacgttggcggtgaggggatgcagagtcccacagagccaggtggttcagttggcgtgggcaccccactcttttcttcagcagatggggccaggcagggtgggggtacagggagacagggtgttgtctgccaattgtagagtgtgttgctgcctgtgtgggctctgcccagttggcacaggctcccctccccctgatactggccggtccccccgttctgtcccttggacatgtgccttcagggcccaaagaggccagggcacgtgcgccagcagctcaagccagcctgtgctgcctgctgctgggcctggctccctggagcctgattggagcggagacatggtgcttgggtgccctgtggccttctgccctggcaggcagcttcagagggtcagggggttgcaagtgcattttgtggtgaggtaagatgctgggagccctgaggagcccatggtgggaaatttgcaaaggtgtaaggaaattgagtccgctcaggccaggcataggcctgtgtgaggcttgggcatggctcctgtcttactcccttgctaatgctgccctggcagaggttgcctctgccccgccgttgtgccagctgtttctagcagcccttgtcccacaccctgtagctgtccttgtctctttgcttccccaggcagctgatggagaaccagattggagcagtggaacgtggtgcttttgatgacatgaaggagctggagcggctgtgagtcctggcagggtgcaggccaggagggcggggggctggcacgagagggaactggcaggccaagctgctgccagggatgaggggcactcatgggaggggaccccatgcccagcctgcctccaccagcggatggagccaggagcagctgcagctgtgaaagtggtcacaaggcatggtcacagagaaacctggagtgggtccccaacccacattctccatgcaactgtccctgttgtttttccctgaagatacgggatggcaaaaaatttacataataatacagaggaagtgacatttcttcctgtcatctcatcctgacataaccgctgtccattgatttgtgtgtccttaaaggaagccgtgccaacggaacctgtcagggaagccccgggggattggtgtcttaggtgcacagggccacagtacagaaatgggaaggtggaggcctgtcctgattcacatggtttgttgctgaatagggcttttaagtttgaaaatgggtcttgatcaatttttacatttcagtttggcaacgatgaaaaaaaaagaaacatagtggggtgaggtgggggatgggcactcatcatgttcacggtggtcgccgatctcgtccttctgaaagtggtttggctgtaggtgttaggagtcctaatgttcatgctctttgaaccagaaagtccgttttattttaaggaaataatcagagacatggctaaaaatcatgtatcaggatattaattgcactttattatttatttatttttgagaccaagtcttgctgtgtctaccaggctggagtgcagtggcgtgatctcggctcactgcaacctccacctcccgggttcaagcgattcccccgcctcagcctcccgagtagctgggattgcaggtgcatgccaccacgcctggctaattgtttttgtatttttaatggagatggggtttcaccatgttggccaggctgatcttgaacccctgacctcaggtgacacacctgcctcggcctcctaaagtgctaggattacaggcgtgagccaccgtgcctggccattgcacattacttaaatagaaaaaaattggaaacccattctagtggatacataagaaataaaatcacatttctgaagaacagtgaagaacacatgggaatgtgctcgcaatataatgttaaatggaaaagataaaaaatgacaatagtattactaaaacaatttgcatgtggatagaatacaggaggaagaagacaactggaaccactaactctcattatagtgagtggtggattatagataactttatttttattctttgtgtttttctcttttaatggattttcttatgacaagtttattattatgattatagctaccaccactctatgccaggcacctggggaagctctttgccttatattatctcatttaatccttaaaacaacactgctctaagtagtatttcacagatgagaaagagaggtacacagagattaagtcacttgtccccagttgtacagaagaggggattagaacccagatcattttgccttcaaagtctgagctcttaatgaagatgacttgatacctcacctttctttttttgagacggagtttcactcttgttgcccaggctggagtgcaatggcgcaatctcggctcactgcaatctccgcctcttgggttcaagcgattctcctacctcagcctcctgagtagctgggattacaggcgccagccaccacgcccagctaattttttgtatttttagtagagactgggtttcaccatgttgggcaggctggtcttgaactcctgacctcaggtgatccgcccgccttggcctcccaaagtgctgggattacaggcctgagccaccatgcctggctctttcatttttatattaaagaaaataggatattaaataaaaggaaaagaatccgattgcctcgttgccctcctacagcctggaagaaagcaaggcaatctttcttttgtgctcctcatccaggcctaaaacgaaatgataaggagcccacagctagaccagatgtcgaatgctgcatttgttttctttaaaagacttagaataaaatacatgttaatgacctggctatgaggggctgatttgaacctgacccaacctggctccacctcttgtgctgggaaggaggggaggagggaaagggtctggggggtcgagacatgaccccactgggtgagtggcgactttaggcctgcaggcaccttcctgagtggtcagttcaatggtcgccgcctgagttgttggagaccagtggcgcatcagttgatcgtaaaaggtgattaaagtgcagagtcattaaaaaccacacataccagccaggcacggtggctcatgcctgtaatcccagcactttgggaggccaggtggtgggggtggatcacttgaggtcaggagttcgagaccagcctggccaacatggtgaaaccctgcctctactaaaaatatgaaaattagccaggcacagtggtacgtgcctgtaatcccagctactccagaggctcaggcaggagaatcacttgaacccgggaggcggaggttgcggtgagccgagatcatgccgctgcagtccagcctgggcgacagagcaagtctctgtctcaaaaacagcaaaacaacaacaataacaacaacaaaaccccacacataccttagacatttcattttatgttaaaacatataaatgtgcatttactgacccctcctcttttttttggccaaagtctttctctttggtgtgaaacgctggtgttctttctgtgttgtttgcctcgcctaaaccacacacgtataccttgttgatgatttttgggtttggtttctggaagatggagtgagattttccaaagggccttgggagcaatctgggggagtattcctgatttttaaaatgacacccacccctgtctgccaccgtcttttacttaattcaacagccctttaattagcagctttcctttcatcgaatctttctaaagcattccacttagttttcatagagatgactctttttccactagcatttcattcatttatgtaataggtaattaaattatagagttagaatggcaagtgcctctggcataaacaggtttgggagtagacataactggttcttgtgagcagttataaactccagagtagatgcagcagtgtgcagttgagctggccaagagggatcaggacattgtggcctcagcgggtctgcaggtggagaggagtggagtgtgcccagtcaccctgggagctggcctggcactgtaccgtggccaggatcataccatgggagcagccaggatggggagtagagaaaggcaagcttcaagatcccacatctaccattcagtaatggcttgggcgagtcacttacctcttggtacccctattctctcatctttcaaagatgagcaactcaacaaagtcagcaaacctatcttgggcacctatgaagagccaagccacgtggtgcagtggtggcaggaaacctctgtggggggtgtttgttgagagtcaggagggtgagggcacgaatgcaaagtgctgttgtcactttcaagagaaagaggcccacctttacgctccgctttcccgcccgcgatgagctcatgcccctaatgcatttgccccatgcctggcacatagtaagggctgattatgatggtggccatgactactgttatcattctcagtaaacttcatgtccctcgccatgtggagtcccttctttagtgtcctttaattttccattttaaactaggcattgaatccctttttcctcctaaataattttcagaagcagaagccagaaaaatgagaaagtcttgggggaaaacaaaacaaaaccagtggttaccaggcagtgtaaatacaggattaatttactggaccaaggataaagaatttggagctatctgatgtctactcctgttgctttaaggattgtattgatgattttatccccccaaggcaatgaagtgtttccctaggagcctgcccttaaaagtaaacttccagtgggtctgcaaaagttgacttaattgtctgtaccttggggaacatggcggtgcccaatgtggtggcaatggcctttctcacatattagatgaaggatgaccttctaggaggtaaccacagaccaattactgctggctacatggaattaagtttttccccttccctctggaagtaagcttttggctgagatggtttatcatacagttgtcccttggtatccatgggggatttgttctaagacccctcagacacccctggggctacaagcctggactaccatgcccagctaatttttttgtattttttgtagagatgacgtttctcttagttatttctctttgttacccaggcaaatctgaagcccctggcctcaagcaatcctctcattcagcctccccaagtgttgggattacaggcaggagccatttgacatgctttttttttcttctctgagacagagtctcactctgttgcccaggctggagtgcggtggcgtgatctcagcttactgcaccacctccctggttcaagtgattctcccacctcagcctcccgagttgctgggattacaggtgcatgccatcatgcctggctgagcatgcatttttattaatgataaaaataatcaataaaactattttctttctttctttttttttttttttgagacagagtttcgctctgtcgcccaggctggagtgcagtggtgcaatcttggctcactgcaacctccgtctcctgagttcaagcgattctcctgcctcagcctcccgagtagctgggattacaggcgcctgccaccatgcctggctaatttttgtatttttagtagagacggggtttcaccatgttggccaggctggcctcgaactcctgacctcaggtgatccgcccgcctcggcctcccaaagtgctgggattacagttgtgagccactgcgcccagctgctattttcattttgaaaaaagacccaaagcaaacaataaaaaaaaaagtgaaacctctgttgagccaaatgtggatgaaatcagggctgtgtggccattagggtatgtctcccatttcaagtgtagtcaggtttccaactcacaaagggaaacagcattggaatcagtgccttagaaaccacacagggcttgcaaatgtgaagtgatgatgatgatggctatgggaagaagtagtggaaggagaggtgctggtgaggggcttccgcagacactctgttcttatcctcccctcgtgctgggtggtggaatctccactttacagatgaagaactgaggcccagagaaggtaatttccctgggatgccacatggaccctgttaggatttgaatactggaccttctgcctctgaatccatcttgtgctttctgagaagtcctttggatttcctggctgtctaggtgatttccaattcttcttctcttttataggcgactgaaccgaaaccagctgcacatgttaccggaactgctgttccagaacaaccaggctttgtcaagactgtgagtgacgctctgtggccagagagttctccctgtggttttgtctctcaccctgtgggaggcacagtgtttggtcagtggggcctggatattcccatgaccctgaccctgtgctcctcccctggcaggaatggtccagggcatcaaaggccaggccctttctgtaggaaggtgctgtgcagggtatttctccatggcaagcacttggaagaacccgcagttcatccagatttgtgagctgccgctgacagtgtgggtacaagggtgttctgcaggcaggcatgcttgtggacggtgatgccagcctttacaggggctcattcttacccatctcactgcgcctttagtaacctgcctggagctgaatatttactcattcaactaagcccttcttgaacctatttctattttcagctctttctaccgtttagggccatgaggtctgtaaggttattaaccatggtataagatcatatttttatgtattgtcaatgtacttctttcaagttcgaaggatagttgctaattctgctgcaccatgatttgccacatgtgtctgtaatttttctaccatatatttcattttatgggaattgggttggacaagacctttgagattatctaaggaatctcttctgcagctccttagcatatggtcccacagtctttgcttggctacctctagtgatggggagctcaccacctctgcagacaatcaactctatcactggacaaataagtaaattagaaaatttttaactttgggccctaaatctgctctccagtaacttacatatttctcagttttgctttctataactacctagtttttgaagagctgtcaggtttttgaattttgagttgggatgttttttagttcccttaattgttgtcattaataaccttaagagccaccggcagggccttctgcatgcctggcacagcactactggttcgtccctgaaggagctatgggtcagcacctaggtagagaaaggggtaataagcaatgtaggtaagactgaggggtgtgggttgggtgagagtggcaccctaaggttacctgagtgctaaggggtctgaccatgggctcctagagtctggggcttgattttgtctcctctgattaaacacagctagttctttctgcctctgccatgatttctagacctctctgtaagcccagtgatctccagaatttgttgttgatcttaccttcaaacttttatttacttatttttgagacgagatgttgctctgtcacccaggccgaatacagtggcacgatcttggctcactgcagcctcaatcttctgggctcaagtgatcttcccacctcagcctccagagtagctgggactacaggtatgcactaccatgcctggctaattttttaattttttgtagagacggggttttgccatgttgcccaggctggtttcaaactcctaggctcaagcgatccaccagcctcagccttccaaagtgctgggattacaggcgtgaaccactgcacctggccaagcttttgtctttacaatggaactctaattttcagtctgttggaatggtctttctggtcacttcctgttgcttcctcctcctggcctggagaccactccacagtgacctttagtgatgatctcttttgctggtctttgccaccacccttgggcttgagttgggccttctcctccagttttcctgtaactgataggttggccaatccattctgtgccaggcatacacagtgggtgcttaatttttccctacttgattgcgaaaggcagaagattcttcccagcaggtgcctccgtggtaatgtctgttgaacctgtgggccatgcactggtctatgtggtccatgctgttgctggccacatgcaagcatctggccttgccctgccttggccccagcaactcctgttttctctctgctgttctttctctgctgacttgcaagtgttatcacagctctgcctttctgcaaaaattcttcttgaatgtcttttctcttggtctcaattgtgcaattctttccccctcctatgtcctcttaacctttcaagcttttgcccttgctctcctggcatgatttgcctacttgggtcccttctccttcccatagtgatccgttgccctctaccttgctgggatcaaggcatatgtatactgtacagttgccgtcaagctctgggtgcccactttcactctccctcattgattttaaaatctccaagacccatcatgtaaatctgaatccaccaacttccagccctttacttgagatcatctccagccatattcatttttagcggggagctgacttcttttgtcataaccttccaccagcccttgggggtaaagggtagctctgcaggggactccctccctcctttactcgagtccacccttctctttggacattggtgccttgcacacacctgtgttccttcctgaggaaaatgacaacttggctgcctccttggcctgtgtctgggaaacctggatcccccctggaatggaaggtggcctgggaagcagaaagtcaagggtcaggtggtcctgggcttttcaaggcataactttgggtggtttaattgttcagagcccatttctcttacccatacatggtagggctagtaggagtctgaactgggactgtgcatgtaacataaccaagcctgcagctggccctcagtggatgttcatccatcatgcccctgataactcagggtgagcaaatagcccctcggtgaagcaggtgctcctgtgcttgatatcttgtctgacacatgtggccatgaggcaagcaatgtctcccactgttactgccagcgagacaggttggaaagaggaagtgacttcccgagagtcaggatgaagccctctgactcctaggcccgccctcttcatggtttcatattttacaggagtcctagaggaaaggacatctatattttaatgagtattaaatagccagattctataaccaaaggctggcacaagaagattaaatcaaggagcaaaaagccattgcagaggacagcactctgtatgatacctgctcttggcaccctatggggctgggaggcagaagcctctagacacattgggtgtcctcattgcagtggtcccaggccagctgctttcgggagggggctggttggcagccaacagagggacttccaggagggcagtggaagtcttggtagccctttgggggggtgtttctaggctctagagccagaacttctccctaacacttactgtcttttctttccaggcatcaggtcctttactctcagcaggaaacatttctcatccaggagcatagcaggatttgggtgaaggcagacttttctttagctttccccttgacatttcttaacctcatctgtaagcaaggcatgcaaaccgagaggactcctgcagggctcttggaggactcccaggcagtgtgccctgcttagtttgcactgaggccaaggcatttggtggccaccaggtcacatctcaaaacgggcactgtctgggggaaatgattcaacaaaccttatttatctggttgttcgtccctggtgtctgggcttaccgggttcttcaccttggagatggttatagggaaggatagaggagcaagtgtttaaagatctacttgttaatattcttctaatattactgtgtacgcatccgccctgccccattctattgacctgagcacctggcattctaaagtatctctgttaactcccccagttggtctggccaaggagtactcggcacgcttggttccagaaacagaataccctgccggctggtgatggtaaaggtagaggcggggttttgtaggggcacagctggcaggctcccaggctcccagagcaggaggtgagatccagctggccctcccagggacctgcactgagatgtgagggccatttctcgttatttctgaatatctgccttattgtcctgctcttccctgcaaaccagtgttctaggatcatcagcagcatctcgattccatcatgactcaggtcagccatggtgccaatttgcctcctacttcctgtgacctcggagctcagatccacacagcgtctcaggccccaactccgggtttctgggagagtgaatctgattggcccatcttaggtcaagaggtcacaccaggccagtgagctgttggcagggattgtgggatccgctggtgcagcaacactatggtgcccacactatctcaggagctggagtgggacctattcccttagaaggcagtgcctggcattcctgttctctcacttgttgacctcccctttgctttgtagggatctgttactaattcttcccatctggagcaaattatggactttcatgcacaggctgttatgctaaatcagcatgaaaatgggtttgagagagaccaaatgtgctgggtaaggcatggtcaccaagtctgtaggtggtggcgcagcccacatttcagttgattttgtctgtgtggcctccagaagttaaaatcctgttaggggttattctgcacgaatgtttcccctgctgtgaggttagtctgtctatttctttcctatgcaggatctatggctcagagaggtgatttgccttggaccacagagcagcttgacaatagggttggaattagacaccaggccttctaggggccctgaagagcctgaaaatggtcttaaaccttgacctaggaatctcatatttgggcatctgccctaaagaaataataaagcatga

SEQ ID NO: 219 - DNA, 89853 bp, Homo sapiens
gctgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaagtaagcctttcccactttgggcatttttcctggtttatttctggcttattatatttcttacaaataatggataatgttgcatgttctataaaatacaatgctaaaaaaggaagtttttatttgttttttttttaagtgtcctgtgttaaagaaatcagtgataccagtcaatgtgaacagtcagttttaagattctatgatttccaataggtattcaggtacagaaattttgtttttaacctttgtagtagtgagctggagaatgaaatggtcacatagactagaagatattttgttgtgtttacgcttttacaaaatagatttggcccttactaattgatatcctttaaaaggaagttattcataacctgtatttcattttattcccacatactatatatttatcttcacttttaaataactctgtgttgcaacatttgctctcataattaaggggatagtctcaatgtttcccagaggataatggttcaaagtgtttctttcaccagagaaatgggcttttactgttatgtgtttctgttttataaatgaagatattattttccacaaacttccccaaatagaagcaagagcaatgtttctgagataatcttgtcggttctatagcaggatggaaaatcagaggagaccaaattgccccagctgtgtgtttatgaagcacagtagctattcaacacgtttaaaacgaagacagggagagtgtgtgcttgtcaaaggggccatgtgatttgtgtctgttgaatctgaatatcaataaggcaaagcgtagagcagctgccgttgaacaagacaacttggcattagcacacagtgttggataatctgggtcaccttctgtggctgcaccagtgagattgttacttgtacggtttacagttgaacatatattagagactgagtgaagaaataagtaaatgctgtgggtaggtagctgatggcacatatagaaaaaccaagtcaaactttaaacaaatgatcagtataatacttgactgcaacgcacactcacaaaagattttttttcatatatatttactaaagagttgttatttaaatagttatttaccctccttgaaacttaatgtgggccccaggcaatgaggaatgaggaagagaagtgctgtgtttagttgtgcaggtaggagaagaaagggagaaaaagaaataagtcataaaatgaatgtgaagtgagtttatggtgcattttatggcaaacagctttgtcattcaatgtaatatatatggaaattcctggagtttgctgcagtttgttttaaaggaaatgaatgtatgatatctttaattaaaagtatagtaactatgaattgataaatatatatcatttgtttttgctctctttgagtaagtgattttattgatagattctaaatactttgtaattattttatttgttctccagcatagtatttttattcgtttaaaaaagtacatttgaagtctcattttcttcgatttttaagcaggtagacttttgtctgtgttgatatatttattggcaagatataatcatattgctttcccaatcaaaacacgtagtttagaccttgttagctgagtttttttcccacctgactttaaaacaatctagcatcagccttcctttctacccttattacctagtattcttgacacaaattctgtgttccagacaagtgaataacataatatctagcagtaaaaattgctaacattgtgttaagcattttctatatcatatatgtcatttacttcttgcaacaaccctataagatagatactatcatagtaattcacattttatagaagatgaaacaaagattcaagtcactataccagtgtacctcaaactttgaggcacctcagggagctggaatgcctggttaaaatgtgcagcctctcaagtctagccccaggtacttagtagatcctaggaaactataatttaattagctcttcatttcaaatacaggtaaccagaagctctgagctatacaataaatctttattaagaacctactacataatgatgctaggaatcatcagaatagttaaatataaacatatctctctcttcaatgagattatttaggagaaaagataaacactatgagctttataactgttgtcactcttatatacataataaccctgtcaagtagaatttattattaattccattttgcagctgaagaaactgaggcacatagaggtttattaatttgtccaaggccatactactagtgaatggtagatctggaatgtgaacctggagatctggctctggagtgtgggctcttagcttgcatgtagttattcccatgaagtgataatgcataaggactttaagtgataatgcttaagcagactttattatgttctgcttggaacataatagcaaacaaagaaatgtccattatccaggtatggtggctcaagcctgtagtcccagcactttgagaggctgaaatgagttcacttaagcctagttcaagaccagcctgggcaacataacaagacctcatttctacacacaaaaatataaaaaattaatggggcatcgtggtatgtgcctgtagtctcagctactcaggaggctgaggtgggaggatcgcttgagactggaaggtcgagactgctgtgagccatgatcctgccactgcactccagcctggtaaaaagggctacaccctgtctcaagaaataaaaagaaagggagaaagaaatttcagttattaatatcatattaattgaaggaatcaatgattctttcttcgaactttgaaatatgttcccttaaatttaagagaaaataatcacctccagctccatactgtattttgtatctaaagttctaccttgctcagctaccaggggaacgctgtttatgttttgatcaacctttatgtccttccagttgaggacatgtgacatgaggaatattagagcagagttcaggaagtgacattccctttctgttcctgagcaggtagacattctcctaacttggagttgcaatgaatttgtcctgattgtttttatacctgttccttgattttgcaaaactggttctaatgtgtgggaccaattaaattttaataattcaagaagagctattattttttgcttctgatgtattaaaagagaaacttattagagtgagactctcctgtgatccattattcagagactgttttaaataataacagtactttataataaactctttttgggaccttgatgtatgaatctgttctgaagggttttaaagaaacaaccataccatgaattagaaaagtaatgtctatctctctagtcctttataaatttgggggtaaacaatattttcaatgtaaatgccacatcgagattaatttaaaagtaactgttttaatctacgtttaaagtatgatcacaacatgtaaaaaaaatgtggtttgacaaaactactttagagttaccagaacaatgttaaagagtttggggtagcatccagtcttccaaaaaccattagcaattattaagtaattgatttgaatggcattattttaaaaagtactttctaaagtactaaaagaatgaagaacaaatagagattaaataagaaataattgaatttgcttaatatgtcagagaaggctgatgttattcattagggagtaatcacatactcttaaaattctacatgtgtagaaacattgaaaactttgatcgttactgtgcaagttaatatccttgcagtggcattttgtaaagtgcctacctaattattagtgtgagaaaaaggtatctttttgcttcctcataaatgaaataatctcatcagtttacagtaaaatcatcactactccatgaaagttacccagggtttcctacattacatagcagagttaactgtggcttcttttattagatacttctcttagcaaaattttctggagaattgcatgcttttttttcatcattggtgattttcaaaaattatcattcatggtctcacaataacaaatactggaattcaagtggacaagaaaagttagagtgagtgtttaagcaaaccgtgctacatctatataatggaatattactcagtaataaaaagaaatgaactatcaagtcacaaaagcacatggagggagcttaaataaatattgctgtgtgaaagaagctcgtccagaaaggctacatattgtatgattccaattttatagcatcctgtaaaagacaaaattatagagacatggaatgatcagtggctgccagagaatcaagggtgtagagaagaggcacaggggacttttagaatagtaattattctgcataatactttaatggtgcatttgtcaaaatgtacagaattttacagtacaaagagtcaatctaattgcatgcaaatttataaaatcatttaggaaatcaaggaaatcccaggaagtaattcagactctgactcaacaatctaactgcattacaaatgtatgagataatctcacagaaggggttggggaaaaactgttcacctaagtagtttatgtacatttccttagatattacctgacatgctttccctgttctagtatcccatccaagatatcacagtacattttgctgtcttgtattttgaggttcctcttggctgtgacagttcctcaggctttccttgtttttgatgaccttgaaggttttgagttctggccaggtattttatagattctcccaatattggagttagttttgtgttttcctcatggtgaaactggagttatgggctattggaatgaagaccacaaaggcaaagggttatcctcattacatcatatctataatattatcaatgatttatacaatcaacatgatatgtgactgctgatattgaccttactcacctgggaggtggtgttatcaggtttccctgataactataaagttatgtcttttattcttctccatactgtactcttagaaaaggaagtcactgtgtgtaacccacacttaagaagtttggagttatgatctctctcctggagggaaaaatttacataaattattcgaaattcttctgcataggagatctggctcttctctttcatttatttatttattcaattgtttattcatatcagtatgaatctattgacatttattttatactctgggttataagtcaatactattttattttgttactcaaattattccatctttggcctgtgggagttcttttcagttggctcctattttcttttcacgtactccccatcaatgtggggtgctttttaaaaaaggattttcttcctttatggctctacaatccctttcagactgatcttgtgtatttcctgacccaatcctagcataaatcaccatttctccaaggagctctgtttccttttattagagaatggtaaccaaaaccaagatctggatgtgaggtgtgcttgttgctgctggggtgtcaggtcttttaggcaatctcagctgaaagagcacagaaatatgtctgtgtactagtccgtgtatatacatgtttctatagatatctctatatgtaaatctgtgtctgtctgtattaagctaaatatgagttcatattgatgcctctaactccatttccacatggatcattctagctgtctccccttgcttatctgtaaatttcaacagtgagaaacctgatttccactatctgccatttattcacttgtttaaattcagtatacatatatagcggtattggactgttaacccatactcctatgggaaacaactttaactgtttaggtacagtacttatagctgtttcattttgtttttagtttttcagaatccacttgtttccaaaactacttaggtgaacagttctcccccaaccccttctgtgagattatttcatacatttgtaatgcagttagattgttgtgtcaaagtctgaattacttcatgggatttctttgatgtcctaaatgattttataaatttgcatgcaattggattgactctttgtactgtaaaattctgtacattttgacaaatgcaccattaaagtattatgcagaataattactattctaaaagtcccctgtgcctcttctctacacccttgattctctggaagccactgatcattctatgtctctatagttttgtcttttataggatgctataaaattggaatcatacaatatgtagcctttctggacgagcttctttcacacagcaatatttatttaagcttcctccatgtgcttttgtgacttgatagttcatttctttttattactgaaaaatattccattatatagatgtagcacggtttgcttaaacactcacctactgaaggacaactttgttactttcagtttggggctattagttcctagggctactgtaacaaagtactacaaactgggtggcttaaagcaacataaatgtattctctcatagctctggaggctagaagtctgaaatcaaaggtaagaagccccttgcttccactgagactccacttggaatccttacctgccttttcctggcttctagtggtgtcattcagtcccgggtgtttcttagcttgcaactgcatcactccagtctctgctactatcacatgatattctcactttatctgtctacctctcttctattcttcttataaggacgtcagtcatattggagtagattcaccctaatgaccccatgttaacttgattacatctgcaaaaaccctatttacaaataagggcacattcacaggtactgagggttaggactctgacataccttggggacacaattcaacctataacatctactatgaataaaactctgatatatgatttaaaaaacacttggttaataccacttttattgggtaaaattggtttacaattgattttttaaacatagtaagtgcttggtaaatatttgtggagtaaatagttgttatgtttcaagagacattatatcgatatccttgtattaacatgtggtagaagaaagattatgctaaacaatgtgcccatattgttctcttattttccccctctttacactgtccctaccttttacatattcagcctttcactttgaattaagtgttcagaaatttcctcctatgtaaatttgccctatgaaattaacttagagtctgatcaatatgtaaaatagcactagaattaggtgtaaacatgcctccatatttcctcgggacaaatagtttagctgtcttccatatgtgaatgttcaattttttaacctactttttttcacaaactgcattcattacttggggcaccaaaagattactttcctttattattgattcaaaacagtgattgcaagttattttactgtgcatgtgttatttgttgtgcttattaataaaatgtcatcttttattttatgtacatatttttgacttaacaataaacagtaaaatttctgaaaggaagaaggtactcagtcatctagtattagatcctattggttgctatggttagcaccctttatcagtcatctagtgtccttcctagtttaataaaaagtagtgattccttcaaagtttcgttgcaacatgctaagtagattgtcctatatttcctagtttttatcttcagaaaagttttattaaaagcaaaaccaaaggcagtgtacttttaataataacactatgggattcagtcatgctgtatcccatactgctgtatcccatactgctgtatcccgtacatgtaggaattagcatgactatttggagttgaatggtttgacgggaccaaaaattttactggttttagaggcaaccaatgtaaagttagttgtccctagccttaagataggataattaataaatattaaaatttactatttattccataatttttttatttacttatttatccaataagtatttattgagggccgtaaatctatatatctgacactgttctaggctccaagggtacagtagtgaatagaagagaccacaatccttgatattgtgaaatttacactttagtggggtaagagagacaaaaaccaaataaataagtaaattatgtaattgtgagctggcaaaaagtgctatagaagaaagcaaaagatgagtaacagagagcagctggaccatgaggatatcacagtgaataatattttgataaagaaaatagcaagtgcaaagaccctgaagcaggagcgtgcctatagtgtttgagatactgtaagttgtccaacataactgaagtggattgagtaaaacagggcaaattaggaaaggtgtcaggggttttacaataagtatctctcattcttgcaatcatactacatagtagctattaagaccattaggacaccttaagcaaatgacagcctagggtacatactaaaaacacagctacaaggggatacaactgagatttaaaacaagtttgtcagattctaaacctcccacaagctcacaccagcttatttattccaaaagataaacattgaggaatttaaaaggccagttattaaagcgttggtggcttaaaatcagccacggtggaagtaatttcatcacagaatttggcaaacactacaaatcagtgtttgggaagatttatttttttaaaaaaagttagtcctaaataataaaagttttcattctacctttaaaattttttcagggtaaaatgtttatagtttcaaccactatcccattcttgtgactaaaatctgccaaagcaggaatggctgatatgtaacctagattaaccgcattgtgtagtctttttggttctccacgtaattgtcctgataattcccagatggatgactcttttctctacattcagaattcttggaacctttaaatacttattttactttctgcaaattagtgagagcagagtgctaatgaggctgagtttacggttcaatctcaacacaattcagtttgctttgcacagagaccagctctgtacaacaagcaattatgtctagtcagatggtctcaaatttgtagtttttaatacaaggagagaaaatgaaattaactcaacaaattaagcaacaccattgaaataatcagttgcgggtttgcagcaataactttttcacataggtgatgcattattattattgtgtttctgtctataattttcattatctattcttttaatatagctgaagaataaatatttatattcagcattaatttttatatgagttgtgtcagtaaatacagattctggctctggcccacaattagttgtgtatctataaatgcatcatttaaactttctaggtctccaatttctcacttgtaaaatgagggggttatattatctaattaccacgttttttcaaggcctacattttatgatttcatgattattctaggtaatcgaatcatagacattgatgagcagagtgtttttagtgaccagtcactctacatgatccagcttccactaggttatattgcaacaaaaaacaaacccaacatcttagtgttaaaacaacaaggtgtatatcttgttcccaccacgtactgtgtgcaagttggctgcagctctgcctcgtttgtattcttcattgctatagtgaatgtttgtcccctctccccaaatgaacatatgtatattgaagccctaatctccaaagtggcggttttagggggtggggcctttggtaggggattaggtcactagggtggaggcctcacacatgggattagtgcccttgtaaaagagacctccaagaaattccttactccttccaccatgtgaggacatatggagaagatggccctctacctatgaaccagaagttggccctggacagaccccatatctactggtgctttgacctaggactttccagtctccaaaacaagaacaacaacaaaaattctcttgtttataaagccacttagtctatgatagtttgttttggcagcctaaacagattaagacattcattttaggacacaatctgcaggggcattcccttttagagaacactgttttaatggcagagggaaaaaggtaatggaggaagcatacaatagctcttaaaagcttcagctcagctttgacatacctcggtttggctcacatttcattaacaaaagcaggtcatgtggctaagcttgacatcaatggactaaagtccatattcaggcataaaatatttggaacaaataatgttttctactccatcttttttcctctttccaacttccagggatcaatttataaacaaatttctttaaataaccattaaaataaatattagaaatttaaaagacttgacaaaactattatttcagcaactatatattaagcagttaaaatgagcaaggtccactgttctccaggcacgtacactgtagtggggtgggcatatgtgtaaaggctgtccagacatttttgcctaagaaaatcatcacactttttaaaataatgtcagaagtctgtgcatggatctggctactattttcacatgtagatagaggtagaaattttattccgaaaaataaaactagtcttgtgtatgaagaaatgttttctgaaagaaaatataatcaagcttgcttcgaaattattagccctaatgaaagtagttatattttgaggttacggtcaactcagatttggcaaacagcatatacagtttgtagattaggaattcctatttctctttaacctcatttcacttatcattagcacctataccagaggttgggtaaggaaagagaggaaaaatgaaatgtaaaattttacattttatatatcaatgcctgaaaattacatcaaacacaatattgcaaggagctacttaatactttcacagactaggagccttaaaagaagcctttacagcctactcattatagtattgactgtatttctacaatttctcctaaagtaatcttaaaataattaaagcattactttctgtaattataaactcaaataattatagatgtaaatataaattgctttctcttcactaacctcattatatcaaatttttttttgtttgttttctggctttttttttttttttaacaacccctctatggagcaactgaaatcaggaaatgtatgtgttgtttaactctttctactcagctgcttcagttagcaggctagctatatgaactacttgaagttcagaatagccatagaactaaggcaaagtttgcataaacgtagttttttctgtaggctggtaaatagcaattgtgtccatgtagagggactcaatgtcaatagtgaaagcagcccactaccccctacccttttattctcatattccttgtttttggagataatacatctctaaagcctttttttttttttaaattagaggagtctatgattcatgttttccttgcctaccagatacaaccaacctctgttacccaatttctctatgtcagacattaggctgaatgtttttacatagtttatctcatttaattgaaaccttgtgatgaagattttattattcccattttgcagagatatctaaggcttggagtgcacaagtaaagccactaaattgttgatttagatacttaaattattttttaatatgagtagttttcacacaaccatatcacacggtcagaatttggaaataccagcgtcaccattcataagaccatggacaatttaaaacttttggtccttctgaattaaacagtcttctatagatacagcatggaaactctgcaaacagacttttggctttatgaagggaagcattaatgtaaatataattgttaatcgtaaatcagaaaaacataagggagagagatgcagtgaaaagatcgtcaatcaagcttgtaagtaggttccacctgtgaataataatctattgctcaaaccataagaaatacaggtattaaagataatttatcatgtattcatcaccagctacatgtgctacaagtataattttaaatatcaacatactgtatgccctcaaagggaatttgttgtgtgactgatgatagaatttcagagagccaagagctttgggaataaactggttttaaaaaatccagatatcataccaaacatgtattctatcaagtacatttctttaaggtattttttaaaactctaataggcagtaatgcgtactggaattgcctaggttacagattgtcacaaaaatatgttttattaattcttagggtcagttgtagtccttgccatcaatataactattttttaaaagaaggatagtttttattatgtcctttttctagtagatatttcactgttaattgttcatggctggtaaactcatatttatgaagactcaaacatttatttaactcaatatgcttttgtttcttcctgacatgtatgtaatcatattttataaagtacattggtcagtgagattgtatgtatgacatcggattaaaaaatttaatatgtaaaataaacacatcgggggcggtcattaaatgatgggtttctgtgctacaactcctgatgctatgatttcactgttcctgtgtaggaccaaaaaatcaatttaaaaaataagtcttagtaattgtgatgcatgtcatttacagactaggttttaagagacactaatccataagttaacaaagtgaaagttggtcgattattgattcttaaagtgtggcaaagactgatgtgagggaacaggcaagaaacaaccaagggcacagtgcatttgggacttaatagaaaaatgaagcagtggggagcgatgtgagatgagggtgtaggggcagtgtctgcataattaaaggctttaaatgctataatgaattatcttatactagagttttcttgtagtcagaggttcccaaatgttttcacactgtggcctgtagagagaggataatatctgtgcaccatacttgctcatgtagtcaggactgttgacaaccagaggtgatcacttggtggcttttgcagctctggcaccctttagcctactcttcacgtgttgggaagtgccatgaaggggggttgaaagccactgaaggactttaaataggaaccctggcatgctcagacttggccagaatgagaagggaataaagaagggaaagcaaggctgtagttagagagacctagcatgaaatgatggagacctcaaacagcgtggtcctggtaaggaagaagcagagtgggcttagatacttcaggggaacattaacttattgtttaatgagaaatgggtgagagcaaaagggaggatagcgaagaatgatttccaggcccctagtttatgtatcttaaataatggtatgactttatctaaaatagtaatgcacggaaaatataggatgaattgttacaatttaaatctctttattttgaaatattggagggactttcaggtgaaaatatccagcaggcagttggatatatccctccaaagttcaaaggggagacccagttagaagataaagagtataataaaaaaaattatagactatataaaacttgcgatataaaatattaacttgctgcttgggttaattacatttttataaataaaatataagctattcataaaaatgaaaaaaaaaagaaaatcaagtctctgaaatttctactgaggtaagaaatcataatcattccttttaaaaataatttattcctttaaaaaataactatgtcacataattgaatttaaaatgtatttgttagttgttttttaaataaaatttcagaataataataaaaaaagaagataaagagttgggtccttacttacaaattcagtaactatcatcaagtccatcctctggactacttattagaataagaagagagaacacaaaaaatctagagcgaagttctataaaataattttacactatggattcaaggcttaaatatgagtgttcctactcattggtccagtaactcttctaggagaaatagttgaaaatgagagcaaaaaatagcatgtgaaggaagccgtatgttatgtataatagtgaaaaattagaaataaccttaatgttattaaccaaatttgcacgtttatactaataaaatgtttgaaacataaattgtgttgctttgggatcaaagaaataaacacagtccagtaatcaaaagtaaattaaagcaatttaaatatttcctgcagtctcttaagaaacgcacacatatacacacatatacaattagaatataaggcacagagaaatattatttctccattttatgttctcaatgtcttgtaaaactattatttctcaattgttatgttctcaatgtctctcactacttcctaaggtctaacctctgaaaaaggttggacctttctcttgaaattctcataggttcttttcttctctcagaaataaatctctactctttcttatataagtcccctctcctgggttcccaaattttgtttatttctttctggttgtcttgattctgcatcacaaaagcccaggaataaagctagtgaaggtacattttttaatataggtgtatggaagatgagcaatcagagccaaaggtacaccagtgggcaaggaagggggaaagaatctcaacacttagtcaaaaggtcatttttgttttccaaaaaggttaagcaaaaataaaaaaaataaaaataaacacatcaggatgtcaaatcttatgtaatctacaatatgcaatttgtggtgtaaaaaatatgcttggaaaaaacaaagaaaaattctggagggaaacattttagaatttttttttctttttttttcctatgttttttggggggaacagatggtatttggttacatgagtaagttctttagtggtgattgtgagattttggtgcacccatcacctcagcagtatacactgaacccaatgtgtagtctgttatcccgcatccccctcccgccctttcctgccgagtccccaaagtccgttgtatcattcttatgcctttgcgtcctcatagcttagctcccacttatgagtgagaacatatgatgtttggttttccattcctgagttacttcacttagaataatgttctctaattccacccaagttgctgcaaatgccattaattcattcctttttatggctgagtagtattccatcatgtatctatctatctagatggatagatatatatcgatataccacagtttctttataccacagtttctagaaatttaatagcaattatcactggacattgaaattacaagggattgcaatatttttctttaattttgttataggttctacattttctgtaagtaggccaaaaatcttcaataaacataaaacagattattatttatattaaaataaattttattttaaaaataatttagttattcaaacaataaattttaagtcacagagctactaacagaagtagctatatatagacagaagtattaagtaaatatttgctatttttaaatactgaaaagttatattagaaaaataccagtttcaaaaatattcaagaaacgaaagatagtttatttcaattataagctatgtgggtttgaatcattttacttaaattctatgttttctcatctgcctaatgggaataattattttaaactgcataggagtgttgtgaggattaaatgaaaaatgaatgtgtgacactctatgacgtcttaacttgatttgatttatagtcagacttgagattcacaatagacttcatcaagcaccaattttacttgtcttgaagaaaatgcacaggaccagtgtcatagcatgcacaatgacaacacagcagaggtctcctgattctcagacacagctttggatgtcccagtcattctgcaccctgggtgtgtgtggccacaaggaataaagctgattgaatacaacttcagctcgggaaaatcatcagctctgagatcctcccttcagtttttatatcaagccatgtgtttgtgactgagtagtcacatctaatcaggtttatgtgattagccctatttcttcagggcagctccatttcattagttcccaattactcgttaaacaaccttgacaatgagttacacatgcttagtcatttccatggaactctcatttatcttgcatcaatataggtaaatatctaactattcctcagttgctgctgcaaatcagaggtctagtcttcagccatttccagagaggaggccaaagaaacagctgttagtcctttttcggtatataaaatgctcaggatagtgcctgacacgtagtaagcaaacaaaaacttcacagaatcattgaatttgttttttcaaaattgacaaataaagtgcatattctgatattgtaatttaaaaaaataatagaacaaaggaatccactgcttggttgtaatatcttttcttcattgataattttcaaaatgattgttgctaaaatcatatgcctctgtcaaattcctttcacgtcaaataaaattaaatcctatgatgtccttgaaatcatgttgtgttacaggtcagtggttatcatagatgactttaaatattcattacaggaatattgagggatgatggcaagtcatggtcttgagagtcgttgctgaaataggctattggagtgtgagttggtcattaaactgtgaaggatcattcatgtcaacatgaaagtccccttgattaggaagttacctagttggtaactgggaatattggttgaaggaagtgaaagtgtagtgaaaagagaagtttgtccaagagcacggcttataagagggttatgcaagaagatggtagctaaactattttttataataaataaccatgaatttgggggtcagagagtgaaaatagagagatgatggggacagaaataagggataagagaatagatgaggcaacttgttagaaggccttgccctttagagaaaaatagccagtaaaatactcctctcagtgggatgtacaacagactagttagaagaatgtcaaattctcatttttaacacatcagtgttactacttataaagcctctctgccttgccagatcttcagttcgattttattacttttatagcttagggagtagaatggtagcaaatattacaactgggctatgaacagatataacatgtcccacattggcctctctgttgaagccaatgtgatagaaacaactcttcttgaggcatcgcagtccagacgtttgatgtggtgactgacagcaaagtgaggcttaacctgtggtgtggtgaagcattctgtgcagcagtggagcacaggtggatgactcaggagactaagctccttctcccatatttaccaaggaaggccatgccaggggaaacacacatgctgagtaaataatgaaagagaatcaactggatagagttgaaacattctcaataaatattaatttttaacaattactagttaatttatttagttattctttgaatttgagcagaatctctttctctcctttttttaattccttgggcttgtgtgtgctctcaagacttagaatgtgaggtcacaacgtttcctgtgatacagacttgaaagagtataggcctttctctgtactcattgtagctcagtactattcctagcttcttagccccttcatggctttttaaaggaaggaaaagctaattattggtgctccaggactgggcaaagccgagaaaaaagagatttttcttttccttcatgtggcatcagtttgattgcttgttttctagaaaatagagagaaggttacctatcaaagggcacagtcttttcccaatagcaatcgtaacaacctcatttattgagaaccgaatacttagaattgtatacaaactctgaatcgtataaaactcctgcaatgtacctgttatctatactttaaaatagcgcacaattattctcatggaagttaagtgatttgacaagttggcaaagtaagtgacagagctagaacagaattaaaacttcttgttattcccactaaaccacctataggtcttgataaccatagaccttagaaaactaaacatttactaattgtttatttgtaatttatcttcccaatactaatgtaacagatttcaactttctgtccaaattaccctaattactaaaaggcctatacacctgtaatgaaacatgaattttgaaatacatttgcacagaatataataaagttttcttagagttaaacttcagtactattgtaggcgcttagtgtctgaagaccactggctgccttggatgacctctaaatgcaccctccagctctgtgatttaatgaagaaatcactgacatagttcccatgttttgcattataatttcataaaatttttgtttatatctgtaatttaatgcaaagccatatggttatcagaaataatggatatttaatttgattatttaagcatttgacttattttgtttcattcaagggaaaaagaaaaactattttgaattctattaattttctgcttcatagagaattagacatttatgaaaaaagttcataacagaagttctcaaagtaaagttaggttgatagattcatttaatgcacaattcttatacacttataaaatttcaaaaattcatatttgtatcatatattcataggtcacaggagaggtaaaatgagtacgtggaatatggcctgaatatataggagctaattagaaaataaagtaatatgctatattttagaaatgagaaaagcagaacttggtaataaagggcttagtttgataaaccatgagttgagaaccaaaagtggttctggcccttggaactgcaaaatagtttcacctactgtaaccaggctaatatattgctcctggtagcctgctgccactccaaaattttctcctcagagtttgtcatttttgtgaattcaagctcttcagaatgtttcaattacaaaaggacaattttacattaacccatcaacatagacttactttcagtttcctaacttaaagtagggacttgaaagaaaaagatctaaaataggtcaacggtagagagtttgtgggggattgtaagcatgtgaaattgatgatggtggtctctgtaacgggatccctgatggatcccacagcagcatggaggctctgacttcttgcaagggagagaggcgctagggaaagaagatgttagagacagtaacaaagcaaaatttcctcatgtgcagtttatccaaggatggctcacaaatagaattattctactcatgaaggaaaaagaaatacaactagccaaatgatccacctggaattatttcctccttagctacacaaacaggtaaaaacaaatccatacattacattttacaattatattctgaagaggtgtccacttctgagcaagatggagtaggtgggactggattcaccctccagcctgaagcaataaaaaaagcaacctggcaacacatatgaaacaatggtttccgagacatcagctatcagagaatgaagagtagtcatccctaagaaatggaaaacaaacaaggtgagccctattgcttgaacttactaccatgagagagtttccgggcaacagcacagggagagggattcatagagagccgagtgtttgaggagacccagacagatgaaattcatgagacggagtacctgaggggagagctgcacagagacagaccagagatctgcagaagctccttttagtattcagctgagtttatatcagcacatgcatgtaaggaaagttcccaagacctgggaaagaataaagctgaaatgattagagataataatgcccagcactcacagagggccaagaattgtacctgtgcccagtagccagactgaataacttcatgatttatgaaacatttggtaggatattgcttcggtagttacaaatattctcctccagattcgatacggtcttgtgctgcttaacaaatcttaaaagcaagacttaaaagaaccaaactgtttctaaaaaactgcattgcagaacacagctcaagaaggcatgcatagaaacaggaaaataagacccaaatgaggagaaaaataaatcaatcaaaacagatcataaattgatccagatgttagaattaccagataagggcaccaaaacagttattacaactgtattccagatgttcaaaaagttaagtagaattatgagatatgagaaagattcaaatcaaacttatagagaaagaatctacaaggtataagacgaaaagtacgttggaagagatgaatgacaaattagacgttgaagggaaggttagtgatttgaagacatagcaatggaaatgatccaaaattaaacataaagagaaaaaaggattagaaaacaaaacaaagcaaagcaaacgaaacacccacaaaactgtgacaactttacaaagtctaagatatgcaaaattggactccctgaaaaagagagtgagaataaaaagttttgaagaaataatgcccaaacttctctaaaaaggatgaaaactatgaatacataggttaaaaaaaaaaaaaaacttgaatttccagccaacagcatgtggagagtgatccatgtagagcctaatgtttgaggagacccggacagatgaaattctcgggacagagtacctgagaggagagctgcaacgggacagaccagagacagaccaaaaaaacaaaagcaaaacaaaacaaaacaaaaaacaaatcccaagtacaagaaacacacacacaaaaccatacccattttctttcttaattatatctcttacttttctctcattctgtcaataagcaggaaatgttttcctgaaatataattatcttctctaattcttgaataatattttgtttttgaaaatattttgtctgtcttttttcttctatggaaaattgtgctctcatttcactctaattttggttcctctgcaggtgctccctattttctttctggtttcttaatgcattttctttatcttcagtgtattgtgatgtgccttggttggggatttatatttactgtatctttattttttcaaatgttatttatgattcttaagactttttgagcttcttgaatgtgaagtttcacaaacctcgtgggtttggggaaaatttgaaccatttatcactttgaatatggtctcttcgccattctctctgttctgtctcagtattcctattagatgaatatcagaaccttttcttctatcattgttgtctattaatcttactaacatattttcctttcatctatttcttttcagctatgtctaatatgctctaatttgttgatttagttttaaatgtcagtgcctacattttccttttcaacagatctgtttgccttttaaaatggacctattcttttttatataatgtgctttatttttcatattacaatttaaaattttataaagatatatatcttacatagttatatatcttctctaaagttatatatcttatgtagatgattatatatctgtagctatttaagtatatagttgttatatatagttatttttatctagttatataaaagttatatttgtcagtctatcttaagggttggggatctaatctatctatggtttctgctaacttgttccttgtttgtttttcttatgacttataattttttattttgagtctttcttcaagaggtttttaaaaacatttgttgtatttatcctatgagtaccttttggaactgcatcctggtcatatccctgtagaacattttttgctgtgcttttgcaaagtagccaaggataccactggctcaaaatcagttttttatgttccctttcgtgtgtgtgtgtgtgtgtgtgtgtgtgtgtgtgtgtgtgtttgaagagaagtggatctcagatcatatgggtactgtaaatgggatagatgcagagtctcagggttttgatttcctggaggtaggatgtgaaaggacaggaagtcattagcttcattgttgctcaccacatccctgacagtaggaagattattttttaggccttctttttccctgaacagctcagtttcacatccccccagctcctttccatgaccattaaaaaccaaactcttgatgcaagggatccgttttttcttcttctctcccctctatcagccaacaggacagacacagtatgaacgtccattgagtgtcatgctgattttcagctctttcatcccctgtgttacctggtgatctccctttccttcacttacatatttaaataatatttgttgtatttgattcattatttctgattatttgtaatgggaggattttaagtttatgtacatttgccctctcactaaaaatagaagttaattatccattcactaaaataaagatatctgtgttaaaatgacatgctttttgtccatgcttttgcaggacaatttccatgcttttgcaggaaattgtgtttcttgtgcctggctctctggtactaaatgtatttttaattgtaatgagctctaatcaagaaagaatttttctttaaaataaatggctttcaaaatgagaaatgaaactaaaatatactgtggacattaatcttctcgattttatacttatatgacaatctcacagactagttcaacgtttgtaaacttgcatttgaataggtaataagtactaaaaataataacttcaagagctaggatgatgacattttaaaacttaattagtaatatttaaatttccatgcaagataattcatttcttggacaatatagtctttaaaaacttcatttaaataaagatgttaataatgaaaatacttaaatatataagtgagtggacatgtgtcttttatcccattctaacgaattgatttttactttattcaacactgtgggataataaacatacggcactttgcaagtattttattttagcttttaattacattgggaaatttaatatttcagtatttccttaattttctaagattagttggttacatgttttatcaaattaatgtttgtgattactgcgaaaatcttatactcaaagtagcttcaaattactgttcatgataaaatttcatttgattgacttttatctcaattcaataatcaaaaattcatgacactgttggattttagttcatgctgttatctttctacagtaaaagcaaaattagttagagattttatatttatttcaagatgtcacatatatttgtcttttcagtttccagagtccttagcatgcatagtgcttaatagagcacattcctggacagcctgttattattcattgaaattttagattgcatatataattataatgcattatatgtacatacatgtgtacatacaacattgcaagtttcattccataatgctctttgctttcccatctatattctccaggaaggcttgcatttaagttaagatctaagtttacaaagacacaacttaccagaatctctgggacacatttaaagcagtgtgtagagggaaatatatagcactaaatgcccacaagagaaagcaggaaagatctaaaattgacaccctaacatcacaattaaaacaactagagaagcaagagcaaacacattcaaaagctagcagaaggcaagaaataactaagatcagagcagaactgaaggagatagtgacacaaaaaaccctttaaaaaatcaatgaatccaggagctgattttttgaaaagatcaacaaaattgatagaccgctagcaagactaataaagaagaaaagagagaaaaatcaaatggacgcaataaaaaatgataaaggggatatcaccaccaatcccacagaagtacaaactaccgtcagagaatactataaacacctctatgcaaataaactagaaaatctagaagaaatggataaattcctatacagcatcccaagactaagccaggaagttgaatccctgaatagaccaataacaggctctgaaattgaggcaataattaatagcctaccacccaaaataagtccaggactagacagattcacagccgaattctaccagaggtacaaggaggagctggtaccattccttatgaagatattcaaatcaatagaaaaagagggaatcctccctaactcattttatgaggccagcatcatcctgatacaaaagcctggcacagacacaacaaaaaaaagagaattttagaccaatatccctgatgaacatcgatgagaaaatcctcaataaaatactggcaaaccgaatccagcagcacatcaaaaagcttatccaccatgatcaagtgggcttcatccctgggatacaaggctggttcagcatacaaatatcaataaatgtaatccagcatataaacagaaccaaagacaaaaaccacttgattatctcaatagatacagaaaaggcctttgacaaaattcaacagcacttcatgctaaaaaaactctcaataaactaggtattgatgggacatatctcaaaaaataagatctgtttatgacaaacccacagccaatatcatactgaatgggcaaaaactggaagcattccctttcaaaactgacacaagacagagatgccctctctcaccactccttttcaatatagtgttggaagttctggctagggcaatcaggcaggagaaagaaataaatggtattcgatcaggaaaagaggaagtcaaattgtccctgtttgcagatgatatgattgtatatttagaaaaccccatcgtctcagtgcaaaatctccttaagctgataagaaacttcagcaaattctcaggatgcaaaatcaatgtgcaaaaatcacaagcattcttatacaccaataacagacaaacagagagccaaatcatgagtgaactcccattcacaattgcttcaaagagaataaaatacccaggaaaccaacttacaaaggacgtgaaggacctcttcaaggagaactacaaaccactgctcaacaaaataaaagaggacaaaaacaaatgaaagaacattccatgctcatggataggaagaatcaatatcgtgaaaatggccatactgcctaaggtaatttatagattcaatgccatccccatcaagctaccaatgactttcttcacagaactggaaaaaactactttaaagttcatatggaaccagaaaagagcccgcgtcgccaagtcaatcctaagccaaaagaacaaagctgaaggcatcatactacctgacttcagactatactacaagcctacagtaaccaaaacagcatggtactggttccaaaacagagatatagaccaatggaacagaacagagccctcagaaataataccacacatctacaaccatctgatctttgacaaacctggcaaaaacaagcaatggggaaaggattccctatttcacaaatggtgctggaaaaactggctagccatatgtagaaagctgaaactggatcccttccttacaccttatacaaaaattaattcaagatggattaaagactttaatgttagacctaagaccataaaaaccctagaagaaaacttaggcaataccattcaggacataggcatgggcaaggacttgatgtctaaaacaccaaaagcaatggcaacaaaagccaaaattgacaaatgggatctaattcaactgaagagcttctgcacagcaaaagaaactaccatcagggtgaaaaggcaacctaaagaatgggagaaaatttttgcaatctgcacatctgacaaagggctaatttccagaatctacaaagaactcaaacaaatttacaagaaaaaatcaaacaaccccatcaaaaagtgggcaaaggacatgaacagacagttctcaaaagaagacatttctgcagccaacagacacacgaaaaaaaatattcatcatcactggccatcagagaaatgcaaatcaaaaccataatgagataccatctcacaccagttagaatggcgatcatcaggaaataacaggtgctggagaggatgtggagaaataggaacacttacactgttggtgggactataaactaattcaaccgttgtggaagacagtgtggaaattcctcaaggatctagaactagaaataccatttgacccagccatcccattactgagtatatacccaatggattataaatcatgctgctataaagacacatgcacacatacgtttattgcggcactattcacaatagcaaagacttggaaccaacccaaatgtccatcaatgatagacaggattaagaaaatgtggcacatatacaccatggaatactatgcagccataaaaaaggttgaattcatgtcctttgtagggacatggatgaagctggaaactatcattctcagcaaactgtcgcaaggacaaaaaaccaaacaccgcatgttctcactcataggcgggaattgaacaatgagaacacttggacacaggaaggggaacatcacacaccagagcctgtcgtggggtagagggagaggggagggatagcattaggagatatacctaatgtaaatgacgagttaatgggtgcagcacaccaagatagcacatgtatacatatgtagcaaacctgcacgttgtgcacatgtaccctagaacttagagtataataataaaagaaaagacctaagtttgttttacttgagtgtttgggaggcaagtattttttttcataaatgatatgtaagaactctaaattctcataaaatcataaacatttttcaacctcttggcaggctatagaattgttaatcctttttcaatggtctttaaatgttgtcatgttgccttctagcttgtagctggcccaaggcctgagtgagggtggtgctggattgtgtcgtcagggtactaaacacctgagtcctaaggatcaaagctgaaaaccaaagtagtgtgtcaaaacccaagaggcaggcaagagcaagggtcagaagcaaaataaggacaactgagagcaatgtgggatatccagcaggttagagcaattgaacttgaagaagtaacttggggctttgtcttgtaggatatagattccgcaagtaaaaaatttttgagccaaagaaagagaggaaccagacactcaagaacttcacagtatcactgagttgtgtgtctcatcatggtatattttgtagtttatatttcactgataatggaatgacacaactcaagcctttgtgtctgcagcacttcagcatttaatagctgaaatatatttgagcagctttattttggtcaccctcctttcttccacccacatgattaagatttgttaatggagatatttgtcagactgtacaagattgtgaattagatcttctctgaagtgcgacatatggctgaggatctaatcttatttctgcctgagaccttgtgtacctaggatgatcctaataaagtattatgtcttcataaagacaaaagccaggcttactgtgaaacacagcatcacatagctggaagagagctactttggtctctactattagatctaagaaagatagcatcttaactcttctaagatttaaaaaaaaatttaagacaaagtaaggcataatccttcattaatagattttatagacagaagactataaaaatatgagcactagacttgagaacctgagttctagaactgtctaaactacaaaatacaaattgtttaaatctctcttggactatttttctatctgcaaaatggagacacaaataatgttcatagtatattaacaagaaacactttttcatcacaggtaaaatcaggggctctagagccagactgcaggccttgaattctatctccactacttaccagatgttttgcctcagaaaattacctttgcaagcctcactttcttcatctataagatggaaataataatggtacttacactattttatgaagcttaattgacatcatcatggtaaatgatttaaaaagtgccaaactgtacctggaatatagtaaacagtacatttaaatttctacttgtgttatccaactagatcactgaatttccttcatattttcttgtatcaaaactgtcttgctacagatccagaagtcagttgtatctccaggtaagaagagagtgatagacttcagaactaaagtgaagtgatttatcattgagatcccatttatccgatattggaactccaggcttttaggaactgatctgtctggtaaccaagttgatatggtttggctgtgtccccacccaaatatcatcttgaattgtagctccgataattcccacatgttgtcggaggggcctggtgggagataattgaatcatagaggcagttcccccatactgttctcatggtagtgaataagtctcacaagatctgatggtttcataagggggaacccctttcacttggtcctcatttctctcttgccagccaccatgtaagacgtcccttttgccttctgccatgattgtgaggcctccccaggcatgggaaattgtgagtccattaaacctctttttctttataaattacccagtctcagttatgtctttaccagcagcatgaaaacggactaatacacaagtctcctccttgattgacttcctctctttattctctagtcctattaggtgagtttgttcttattatcttgttcttgctatattgggcttttctaatcctgagctctagttttcctatgactgggccactgaatcttgtggcatgggtcatctgaaacgccatcaactgcttgccataatctcaattctgtcccgtgtttgcaccttgtccaacactcctgatatccatccccttctaatgattttcttcatgttgattatctgctcctaattgttcctttctagacttgaaaaatattaaattgtgctattatacatatattagttgtctttgggagttagagtccacaagattttttggttaattgaatgtgttaggaaaagatgaggaaggatccacgatgaacctgaggattctggcttgatcaattgtatggccagtacttccatcaactttctagctgaggtatggagtatggcaggaggaaaagtactgcatgggagtgcaggatgaaagatgaccagtagcgttgctatgtttgcaagttgagttagaatggagatgtcagatagtgtgatagccttcatgctgaggaaagagggatgtgctagagattacaacttgggggatatcaatctatacgtagcaagtagagatctgatgattgaggatcacccaggtgagagtccacagggaaaagggaagagggcccctaaggtccagtcattttaaatgacaactgagaaaagagaattcacaaaggagcctatagaacttagaggggaaaagaaaaaagtcagaaaagtatgaagctataaaaaagaatagcttttaagagatagagagataagataattcaaatatcaagacttcaagtaagaaaatgactccaaatgtgttattactggggaccctggccagtaggttcatggggtggtgaggacagtagccagatggcagttggctgtgcactgagtggaaactgagtgagaatagatggtgaacatagacaactgttctgagaagtctggctgtaaagaggggaaggcagatactacaggagccatagggaaataaaggagagataaagagggttatgttatgtactttgcttcttttcttttgttctatttttagcaaaaatgtgaacatgcttacatacttacagagaaaagagaaattgcagatggaaaataaagagaggcaagaccctacagggaagtaaaagaatcttattctgagcacgctgaaattttatccttggataaagagacaaaacctagtagcctggttaataggaggaaaacaggaatagatgtatatggatgtagataagtctatatcactggtacagggaaattaaagaaggtacctctaacaggttctatttactctgcaagtaaattgcagacgatgaaaaagtggggtaagaggattaaatgcttcaggcgagaggaacctttaagtagtagttttctccacaaattttggaggttaataattttcagtgttttggacaaaatgaacaagttgattctaaaattgaggagaataacaaagaataaaactggctaaaacactcctgaggaagaataatgacttggagggaatatgtcctaccagataatatagcaagaattattataatgctataacaattttaaaaggatgacattggctcaaggggtaaatatataaaacaaagactcagaaacggccatatataagtggaaaattatacataagagaaatggtattgccatcattgggaacagaacaaatggcattaaaatttttttgcccaattatttattgatattgaaaacatagagttgatcttcttctcatttatacataaaaactaattccaaataaattaattacatgggaaaagcaaaaactttatactttacaaaagcaaaagaatatttcattacctcaatgtaggaatacatttatttaagacaaaagtggtaattatgaaaaaattaaggataaattcaattacattaaattaactataatagtcaaaaatactgtaagtaatgtagaaaaaaaatcaacaaactgggagaaggaatttgcatggcatacagtcaacaagataatgatgatcttagtatgtaaagcactccttcaaatcaatgagaaagtgacaatggaccaattaataaaatggaaatgagacatgaagaactatttcacagaagaggaagcacgaatggtcaaaaacataagaaaatgcagtccatctcactagttatcagggaaatgcaagttcagatcacagataaatgccattttgcatctagattggtaaaaatgattacatcttacaaagccaacctgacagacatgtggaacaacaagtaagagtgactcttacatagaactaatgcatgtatccattggcataagctctggaaagcaatttgaagttattttataaatttgaccataaatttactctaaattgactaagtaattccactcctacacacacactaaaggaaaaatcttcaatgtgtatgtgcaatcgtgtacaaatcaaaatatgtaaaaaaagttcatacagcaaaaaacttgaaaaataaaagtatttttgccttgacaagaaaaggaaaaaaaaaactgtagtatatttatataacaggttgttagagaatattgaaaatgaatgaactactgttatgtgcaactacatgcataaattgttaaaacctaagttgaaccaaaaaaggcaggactccatagaccatgatgtgctatacagacgtgcctcattttattgtacttcacagtaatgtgcttcacagatactgcattttttttcacaaattgaaagtttgtggcaactcagcatcaagcaatagcatgtgctcagtttgtgtctcggtgtcacattctgataatttttgcaatatctcaaactttttcagtattttgttacatgtgttagggtaatctgtgatcaatgatctttgatgttcctattgtaattgtttttgggcaccacaaaccatgcccatatggcaaccaacttaattgataaatgttcagtatgtctgactgcttcactgataggctgttcctctgtttctctccctattctcaggcctccatattccctgagactaaacaatattgaaattaggccaattaataacgctttcaatgttcaagtgaaagtaagggtcacccaactatcactttaaatcaaaatctagaactgattaagcttatggaggaaggcatattgactaagataggctgaaactaatcctgttgtgccaaacagccaagatgtcaatgcagaggaaaagttcttgaagaaggttaaaattgctactccagttcacacacaaatggtaaaaaagtgaaagagcctttttgctgagatggtgaaagtttgagtggtctggatagaagatcaaaccagccacaacatttccttaagccaaagcctaacccggagcaaagcccctactctcctcaattctatgaaggctgagagaaataaggaagctgcagaagaaaagttggaagctagcagaggttggttcataaggtttaagggaagaagccatctccataacataagagtgcaaggtgaagtagcaggtgctaatgtaaaggtgcagcaagttattcttaagatctagctaagataattgattaaagtggctacactgaaaagcacattttcagtgtaggcaaaacaacctcctgttggaagaaaatgccatctaggactttcatagctagaaagaagttgatgcctggcttcacagtttcaaaggacaggctgactctcttgttaggggctaatgcagctgatgactttaactgaaactagtgttcatttatcattcagaaaattctaggccccttacaaatggtgctaaatctactatgtctgtgctccataaatggaacaataaagcctggatgacagcacatctgtttacagtatggtttactgaatattgtaagcccactgttgacagctaatgctcaggaaaaaaaaaaaagatttatttcaaaacattactgctcattgacaatgcccctagtcacccaagatctctgatggagatgggcaaggatgtgaatgtttttatccagcccatctatgaatcagggagtaatttcagctttcaagtcttttttttttttttaagaccgagtatcactctatcacccaggctggagtgcagtggcgcgacctcggctcactgcaacctctgcctgctgggttcaaatgattctcttgcctcagcctcctgagtagctgggattacaggcatgtgccaccatacccggctaatttttgtatttttagtagagacggggtttcaccatgttggccaggatggtctcaaactcttgacctcaggtgatccacctgcctcaacctcccaaagttctgggattacaggtgtgagttaccacacccggcttcaagtctcattatttaagaaatacattttataaggtgaacactccgtagatagtgattcctttggcgattctgggaaaaatccattgcaaaccatctgggaaggattcatcattctaggtgccattcagaacatttgtaggtgcctcattaatgcagtaggtagcatggtagtctcataatctgaagaaacattcatgattcatgggaggaggtcaaaatagcaacattaacaagagttggaagaaattgattccaacccttatggatgactttgaggggttcaacacctcaatggaggaagtaactgcggatgtggtggaaatagcaggagaagtagaattagaagtggacctgaagatgtgactgaatagctgccatctcatgatcaaagttgaatggatgcaaagttgcttcttatggatgaaaaaaaaaagaattttgtgaaatgaaatctactcctggtgaacactgtcgaaatagcaacaaagattttagaatattacataaacataactcataaaacagcaatgaggtttgagaggattgactccaattttgaaagaagttctattgtggttaaaatattatcaaaaagcacagcatgttacaaagaaatctttcatgaaaggaagagtcaatagaagcaacaaattttattattgttttgttttaagaaattgccacagccatctcagccttcagcaaccatcaccctgatcagtcagcagctgtcaacatggaggcaagaccctccaccagcaaaaagattatgacttgctaaaggctgagatgatcgttagcattttttagcaatacaggtttttaaaattaaggtatgcacattgtttttgcaggcataatgcaatggtacacttaatagactacagtatagtgtaagtataacttttatatgcactaggaaaccaaaaatattgtgtgtctcatttcattttgatatttgctttattacagtagtctggaactgaacctacaatatctctgaggtatgcctatatttgtaaatcttagggataaataaaaagtaagcaatataaagacctaaaaaaggctaatatacacaagatggggccaaaaaatggaaggcaaagcctgcaatggtgagctaaatgttaggagtgaagtctgagtctgttcaactgtctctgatagagtaattgacaaaataaagaatagaaaattcagaataaagttggccaaagaataatatttatgccataaagtcgatgaaagaatataagacaagatctcatggcaaaatgtgggggaatattaactagggacacaagagcccctttaggtcagcttgggctaaaatctgctagtgttagaaaacacatcaaattaaaatcagaaaaaacaaacacatttgtgaaactaaatactcctgtatgcaactgaagggaagtaagaaggtatgtcaagttctctttaatagttccagatactttcccaaggcaccacaaatcacacatatttcctgaatgtctcatctttaatgaagctgcactaagtagaagcattttgtgtgtcatcaacttggtttccagccattctacttttccattatcagttatttgctaaaataagacccaggctcaaattaagaggccaattattcttttatttatttatttatttatttattattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaatatgtggtgtttggttttttgtatgaaaagaagatcttgttcatttttcctgtttctttttactctgaagtaaaggagatattactagtagcagtagaatataaaaataacaaataattgtaccatcagatgactgtatctagcttttgacattgtttaatattatctaccatctagctttactctccccaacaagtctattaagtgtcaagtcatctcaaagtcaaatatcatgaaattcagaccctgaaaaaaaaataagcgacttgtcctagctagattgatgatagaatcaaaactaacattcagatcttttgactcatgctttccttgaatcaatctaaataagccactttagatttcacatgtctagtttgcctttatctaatagctaaacttatttttattctaacattaaaagagaatattatgcatttggaaaaaatgctgttgaaaacatacattgaagctgagagtgttggtgtgtgcctgtagttccagctacttgggaggctgaggcaggagtgtagcatgagcccaggagttcgaggttgtaatgaactatgatcatgccattgcatgccaccctaggtgacagagagagacgccatctcttaaaaaaataaaaacataatattttaaattagacattgtgttttggaaaaatggaagagttatactctaaagatctttcaacaaatcttcagtatgcctttactaaatggagaagctatgtattgatatgtggtaatactattggtggatcagaaagtattaggtaattctaggtcattatgaataccaactgaaacagttcttccccaaaatcttcatagcacatctctcaaaaatggaatataatatactctttaataagattattgtctaattttttaacataagttaaatgcaattagatatttgattttctaatggttacattttaaaatatattgattttgattttgaataacattaaatgtttttccacatctagggaggacacatctatgactagcagtggcatgtgctcaggaaaggtaaatgtatgtcctggttcaggtgtattctcacttaacctctatgattttcatattcttcatctaaagttagaggagtttatttagatgcctctgtggtagatactatgggttgacttgctcagccttcatcccaccctccacctatgtggttttctatattgtagattctggaaggctaaaactacatttctcactttccttgcagtagggttctacacataaattaggtttcaccaattaaaaacacttggaaggcagaagtgaagtggaaatcattttcctcttttggctacatctacaggcttgcacagttatgatgacatgaggatcttggcaacagcattccattgtccactctccagctacctaagtgtcaagaggcagttttgacaaaggcagtgccaatcctacccattcaccagtgttcattcacttgctttgtgaatgttcagggaccatggcaatggtggcagtgacacagaggcagtcctaatccttggatcatagctatgaccttgtgttttgtattcgacaattccagcttcagcctgagagttctgtagtgttctgttagtcattactggaaggccctgcagagcctattctttcagccattccagggatgccttttgcatcttattctcaatactaaatttatttctacttaaaatacttagagttggtttttatgtcctgctctgaaacctgatatctaagtttgctgtgtgctctaatgttcttaggttactggggaacttggtgtgttttctaaaacatagtctccaatatttatggtaatttcttaaataatttaagtttctttctatgtagagtctatttgtaatgtaattttattactatcctataattatccttgttggtgttgagtacatgggagtcaagtgtataaacatatttgttaatgaatcaacagcttatattttcaggaattaggatagctattaggtgctattaaaatagagtatacatatatgttccaaaaaattttatgtactgatacaatgaattagaatgtctgaagtagatataagagtgtataattaactgtattttctaaaaggattttttgtatgaatatgaaaaaatattatttatatatacatatatatagagagagaagagaaataattatgcggatgactgctaataatctgtgatttttttatgagcgtccttttacagcattcatcttgggttaaccattacaacacctgaataactatttgatatttgccgtcacctccttaacgtcttgataatcaatattaactgcacatgaacactttacattcttcttgagctaaaactattcaaataccttcaatccttgtgaatattttcccaaattgcaaggagttcttgcaattcctctattctttatattttaaagaatgtaatacagaaagatctacataatataggtgataaattactcactttggaaactgatatttgagatctaattgaaaaaaaaaaaaacaaaaagcaagaactgagcaagcctgcaacattatcagtctcaattctgggaatatctttgttactgaattgtaaggagtgcaaccaaggatggatgataggtggggaaaaggaagtatagtgttcagtcctaatattggtaaagagtgcctggaaacgaacagcaccaaggaatgtaagcagaggaataggtcagatccaggaaaggaagcagggtagggcacatacaagaacatgtttcagaggaagcagctggccagcagctgctgaacactccagaaacagagagattcaaattgctatatagcaagctgtaaagtccaaaatgtaggagaatgggtgggtcccaggtggtctgagggaaattgaatggtcaaagaagaaaagtcgtgaaaacagtccagccaataataaaaaggataaattaggataaaacaaagataagatatctgaagtatcaggaatgagtatctttttgatattgaaggcagatatcctgtcctaaattttgggttttctattatactttggaaggaagaacttatcctacagtaaacagtccaggctgagcagaaaactgaaagtactacgctgagatggaatatatactcagaggcaaaaagcctgtcatatccattgggtggcaagcttaggattgtagtggagtgttatgtggagcagtcaggctctgggaagataattttgtgctgagagcaagacttaggcacagaaacctcaagggacaaggatcaaagaagagagaaaaattggtcctttgctgaaaattcacttgcaccaaaaagaaaatcacacagaaaggcatgaagtaaacatccaaagtcaagtagagaggggtctctgtctgtgctttcttgccatctacagtcattttcacagcagacaaaagcccacaggtgctcatttctgaagcagggcaaatgcaattagctattacaactcaatagaatgatctgtattctagtcacatcatgttgttagttgtgtttcttagcagcacactgaaaaaaggagtcgatttgtgtggcctgaccatttttccctcttatagtaaaaacaaatgttatgtctgaaaatttagatatttttacctttattttatttgttctattcaaagatattttgaatataagtggtacctgtaggcaaaaatcaactaacatttattaagcacctttttgcttgcattttacatataatagtttatgcagaactatatagttttcacagaacttagtaagttctcatagaactgatagtaaaacttcagactaagaatcagtattgcagagttcaagcttcagatgtatttctaagcagctaaaaccttgagcaaattacttccccagtcattggtttttacaactgcaaatgaggatgttaaaagctgttttacagcttgtttggacaggattaaaggggtttacatatgaaattctgttaagtttaatgaatatttattaacaaaataatgtttgccaaacagcatgcaaaggcttttgggatgatacaaaggaaataagctgtggttttggccattgaggtctgagtctaaagagggagactgaaatatacactttaaaattagagaaaatgcaggaactgtgagagtacagagaagttcagtatgaaagtaactaaaataatagccacatccaatcactcttgatgttcaatgagttattttctctttttgtttaaattatttctaatcaaaaggcaaggaacagaaatgtccattatcactgacaggtagatgatttacagttgtgaatgatgagttactcattaatgtattagtactggaggtattacgatgcagtaggtcagagccccaaggctcacagcaggctcttgtccattgtaacttaactatataacttggaaacattccagatcctctctctccctggtccttccacttactagctacgtgaccttgaacaagttacttaaactctcttttcgagctaccatttaacccagcaatctcattactgggtatatatacctcaaagagaataaatcagtctaccaaagagacacatgcacttgtatgttcattgcttcactattcacaatagtaaatacatggaatcaatccaagtaccattaatggcaaataggataaataaaatgggtatatatataccatggaatactacacagccattaaaaatgaaatcacgttatttgcagcaacatggatggagctggaggccgtaatcctaagcaaatgaatgtggaaatagaaaataaaatactgtattttctcacttataagtaggagctaaacgttaagcacacatggacataaatatgggaataatagacactgtggactacttggaggggggcatgggctaaaagctacctattgggtactatactcactatgtaggtgatgggatccttactccagtcctcagcatcacggaatattcccatgtaacaaacctgcacatgtactccctgtatctaaactaaaagttaaaaaacaaaacctctctgttctaatttatcatctacaaaataggagtaatgataggttgtacattgtaagattattatgaagattaaatgagctaatctatataaaaatttttaaaaagtgctagtaaacagtttggacttaataaatgttatctatattcatgaatgtcatttttactataatgatggtgatgatgctttggcatatctttttgtaaaatagagaataaaaagatttatctattagttgtatgatgaggattaaaatttaaaatgtctggtttaataggtccttaataaatatgaactattatgataatagtgattactactaaaaatcattccctatatatgtttagcatttcacaatataataaatgcttttatgtaaacaaataaataaaaaatataaatttataaacatataaaaatgtgtgtgtatatataggatttacagtatctacatatatgtatatatgtgggtatatatatgtgggtatatatacatatatgtgggtatatacatatatgtatatatgtgggtatatatgcatgtatatatgcaggtatatataaatatacagtatatatgtatatacacaaacgtgtatatgtatatatttatgttacatgtatatactgtaaatcatatatacacatatacacacacacaatgacacacatatatttatatatttatactcacatatattcatcagtgtgagtatatatatttatataaataattcacaattgcacaagagatgaacaggccagattgttctattcctatgtattattcacatttcatagtttgttcattagactactgtggtcttctacagaagatctttgaatttgaatgtcttactacgtctttgctgacacacacacacacacatacacacagtttctggttggtatgtggactaacataacaccttctgtttaattaattctgcattcttttctcctttcgtttcttccattgctttcctacttccataagtataacactggaatccacatatttagagaaatttacggccaggcgctgtggctcacgcctgtaatcccagcactttgggaggccgaggcgggcggatcaggaggtcaggagatcgagaccttcctggctaacacggtgaaaacctgtctctactaaaaatacaaaaaattagctgggcgtggtggcaggcgcctgtagtcccagctatgcgggaggctgaggcaggagaatggcatgaacccgggaggcagagcttgcagtgagccaagatcgtgtcactgcactccagcctgataacagagcaagactacatctcaaaataaataaataaataaataaataaataaataaataaataaatttacttatgtactgtagttgttcaagatgaaggttacacacagagaactgggtatgttatttatgagcatatttgcattcatgtagcatcttaaatgtagttggcaaccctcttctagcacaatggacacctgctggactaacaatatgtttatacaaggaaagtgaaaaatatctacgtttgcacactggctgatgaaatgaaaatagtttaaaccagtgatttttgtgtatagctttcttttaacttttttatttgggctgagaaccatgtgtgcaatggtatgatgtttataaacatttgaatgataaatttctctatgcacagagttacccaacagtgtaggtttacaagaagacactacattattgaaaacaaagtaattaaattttcgaggtcaaagttcaaggaggatcctgcccttgagactctctttccctcctcaaggagaatgagaagcctcactgggttggcaattttcggaatagaaaaatataaaaaaaaccctgacatcttccaggcctaggaacacatcgtcttttgtcttcgccctcaccaaacctatgcagaatgttgtggcacctaaatccccgtttctgggctggagactcagcattatctcttgtcaggaagttgtcagatccctgcatctgcagaccacagataatagggaaaaggaacgtcaaggtaagatctgtgtaattaattagcttgttgagcaaacagttgaaagggaaatgaatttattaatttttgaaatgtatttttaccagattaagagaagctttagagttctatcaaaaaacttccagatcaatcaacaagtgatacatatctatatctatatagatatagatatagaaaattcagtgaataaaaaagaagttacatactaataaatatattagcatattctatctggttcacctgataaccatatttgcatagtcatattagttcaataatgacttttgtttttaatagaaattaaaattacatagggcagtttaggggagtaggaaatatcatatgcttctctttgcattatgtttgttaatatcccattggccaaagcagtcatgtagccaaacctgacatccacagggtagagaaatatattctcccatggagatgaagacactaatgaatattttgatgaacaataatctcacctatgacacctgccattcatctgacatagaaatttccgatgaattaaaaatctaaacttaaaaagctaagctaacttttaaattttaatggttttatactgacacaatttcagacttctaaagttgttgcttgcagcattagtcacagtagccaagacatggaaataacttaaatgttccttgctggattcatacagaaaatatgatatacatatgcaatgggatattattcaaccatcaaaaagaatgaaattctgccatctgtgacaacatggatgaaccttgagggcattatgctaggcgaaataagtcagaaagagaaatgcaaatactatatgatctcatttctatgtggaattttaaaagtcaaacccatggaacatagaatagaatggtgattaccagagcctgcagggtgaggacatttgagagatgttgatcgaggaaacaaacgttccgttgtaagatgaataacccctggaaatctaatgtgcaagaataattttgctttccaagattatacaaaatatttcttgtatttcattaaaaattcatagtttttaactcttgttgcaactactttatttttttccggatttattgatgtacaattgacagataatattgtacacatttaagatgaacactatgatgcttagatatatgtatatattgtgaaatgattaccacaatcaagttagttaacacatgcatcacctcatatagttagtgtgtgtgtgtgtgtgtgtgtgtgtgtgtgtgtgtgtgtgtgtgtgttgagaagatttaagatctactctctctggaaatttcaagtatataatacactattaatattatttatatcttttaatgggaaattccccaattaccagtgcttatctgtttcttatagatttgtaggagctctttatctgttaaatatgctggattcttttgctcatcttttaaattttgagtgatatatctttctttgtacagaaacttaaatttcatatagccaagtgtaagtaaaacctaaggcttttctcatagtttctgctattcttttctgtaagtcgtaagtaaattatcacatcatagattttcccataaacaacataacttaggcatgttgctccagatttgatgagatgaaaaaatttttaatgtccctgaaaaaatatgtgtatataatcaatatacaaataaaccttagcaaggaaagataactacatagtaactgtttattagttgctattcactgaaacaaaagaaatcatagaaactgaatgaatatgcaacctctgtcagtcataaaacattgttaacaggctgggtgcggtggctcatgcctgtaatcccagcaatttaggaggccgagatggatgaatcacctgaggtcaggagttagagataagcctggccaacatggtgaaacccagtctctactaaaaatacaaaaaaacaaaacaaacaaacaaaaaagctgggcgtggtggcaggcacttgtaatccgagccatcaggaggctgaggcaggagaactgcctgaacccaggatggggaggttgcagtgagtcgagatggcaccactgcactccagcctgagggacaagagtgaaactccgtctcaaaacaaacaaacaaacaaacacccaaaaataaaaacaatctgttaagatagaaaaaatataatatggctacaaaataatgacaattatctattcaaataaaataaaagagagcacttttatattgtgttttttacacatagcaacatttaatattattcttgtatttttcattatctgtaatatatcaactgcattaatccctttccacaatattttatccagttaaatttttttacacatagcaacatttaatattattcttgtatttttcattctctgtaatatatcaagtgcattaatccctttcaacagtattttatccagttaagtttttttattttttaaattgacacatcattgtttgtattagtccattctcacactgctataaagaactacctgagactgggtaacttatgaaggaaagaggtttgattgactcacagttcttcaggcttaacaagaaacatgactgggaggcctcaggaaacctacaatcatggccaaaggtgaaggggaaccaagaactttcttcacgtggcagcaggggaaagagaatgtgtggtggaggggaagtgccacacacttttaaaccatcagattttgtgagcactcactcactatcacaagaacatcatgggggaaatctgctcccatgatccaatcacctgccaccaggtccttcccccaacactgggaattacaattcaacataagatttgggtggggacacagagccaaaccatactgttgtacacattttttgggtgaatgtgatattttgatacatgtatacaatctgtaatgatcaaattaggccaattgagatatacatcacctgaaacatttatctcttctttgtgttgggaacattacaattctttctcttctagctatctaaaaatatgcagtaaattatggttaattataatatcccttatttactatcaagtactagaatgtattccttttatcaaattgcgtttttgtacccattgaccaacttctctttatacctctttgcttcctttccctttccagcatctggtaaccatcagtctacctccatgatatccacttttttcactcccatgtataagtgagaacatgtgatatttgtctttctgtgcctggcttctttcacttaacataatgacctccagttccattcatgttgccgcaaatgacaggatttcattctttttgtggtatatatactacacttaaaaatccattcatctgttgatggacacaggttgattccatatctcgcctattgtgaacagtgcttcaataaacgtgggagtgcaaatatctcaagtctttaatctattttgagttagtatttgtaggtctggttaaattttaaaagggtaacagattcattaactagcacagttaaaaccagtttaaaaacgcctggctaagatttgctaaaaacctgactaagatttgctaaggttcttggatcgacatcttccaccaaatttgggaaatatttggccattattaattcagaatatttttcctccctgttctttttctcctctccctctggtactgcaattatatgggaacctacttggaattatcccacagatcactgcagctctctgcagttttttgaaatattttttctttccattcttcagattatgtaatttctgttaatcgtcttcagatatgtgaatccttccttctctggttccaatgtactgttcagcccatcaagattattcttcatttcagatattttacttttcaattctgaaattctcattgggtccttcttatagttttcatttctctgcaaagttttctcattgtttactcatattcattcttttatttaagtccttgaaaaatattaagttcttgcaagctaatttcaacagttatgtcatttcaatatttatacttttttcttgattataggttagatctaataatttttattgtatattggacattcagacgataattaaaggggttcctgattatgttaacttcctttaaaagatttggaattttgttctggcaggcagctaaaatatgttttttccctgtaaatcttgattttattctttgaatgcttttattttgtttttgaatgtatggcatctttctttctgtataatgtggtctctactcctaaagaaaggcctttctggtttctcaatgcttgagatgtttagtgtcatgtctctccctactggctgagctggaactccaactctctaatttctgacagttttgtttatctctcaatctctcagcagatgatatctgctaggcccctcagagacccatgatgattaatgagtcttttgagcccatcctctgagtggctctttcttctctggtgctctggcctataaactctaattgcttctgctgcctatgactctgacctcatcctcttcagctcagaaacattgctgctcatctcattgtattccttctgtctgcccacagcacaaaagccattccaaatccaaatcccaggagatcactggtgtatttatgtgtgtttcacatctagcaaaaatcatagttctgcactaacagtgctcagttcccaaaaatagaaacctcatttatttcctacctttttttttagttgtttacatcaggagggcgagtcttgtactagctaccctgtcattccatcacaatggccaaactagtttggtttcacaaaaggcatcaaatatttcctgtgtgtctttgtgttaagcactattttacacatatgaactatttattatctcatcataacaaatttcggaaaagcttggggttgacggtaaatgctatgtcaacacagatcagccaaagacacagtttcagacactttctttctctcagctccaaagctgtgcctgcataaaactaaaataaacagatggaaagcaaaacatgctgaggggtacaaaaatccacatgtgtggagaaaagtaccagaaacaacatctaatttttccattcatatagactctctaagagtgaaattatacttcatgaatataaatatccaaacaaagacaaccagctgaagcaaagtagtgtttgcatcaacttccacatatttgtttagactttcccaaataatgtgcttaattaaaaataaccttcaggtgcaatgagttgagttgttcagtttattcaaagtaacttgctcttatttgagtgactagatgcatttttatttttgttttgggtgaattcagtatcctgaaaatggccaacacttatttgaataatttaaattatttcttttcaaataaaatgtttaagatataacaattgcttcttacactaacattctaaaaggataatcttagaggtgaactgaggtcaattgccatgtataaagcttattctgacttcatatttttgaagattagccttttatttacaacaatttttctactcaatgcatcattgctacaggttttggtttaagaagtaaccctagatatatcttaagatcttcactaggggacaggggttttaaacatcattgccatcatcattcttgcatcatatcctcatcacatgagctttggttcaaaaatcagattttaaacgatttcaaagtcagacttttttttttttgagacggagtctcactctttcgcccaggccggactgccgtggcatgatcttggctcactgcaagctccgcctcccgggttcacaccattctcctgcctcagcctcctaagtagctgggactacaggcgcccgccaccgagcccggctgattttttgtatttttagtagatacggggtttcaccgtgttagccaagatggtctcatctcctgacctcgtgatccgcccgcctcggcctcccaaagtgctgggattacaggcgtgagccaccgcgcccgtcccagatttttatatgtgtctgttggaatataagaaccaaagcaccataaactccagctataaaatttgcttgttattaatacacaaagaaagtgaatattaagagacgaagtctgagccaagaaaataaaaaaagtaattatttttggtttaatttatacatgccatttttgcacaaaatagtgccaaaatttaatgtcacattcaaactttaaaattcattgaagcaaactctctctgtttagagatgccatgatattacatggagaacaccccaatgacttcaccaaaaaaccattaaaattaataaacaagttcagtaaagtttcaagatataaaatcaacatacaaaaatcagtgatgtttctatacaccaatagtgaattgtctgaaaagaaagcaagaaagcaatttcacttacaatggctacaaaaaaaaaaaacaaaaaaaaacccagaatgcctagtaataaatttaaccaaggaggtgaaagatctctgcaatgaaaaccaaaaaacattgaggagagaaactgaagaagacacatatatctcatgttcatggatcagaagaaataatattgttaaaatgtccgtacaatgtacacctctgcacctgcagattcagtgcaatctctatcaaaatagcaatgacaggtggggcacggtggctcacgcctgtaatcccagcactttgggaggccaaggtgggtgaatcacccgaggtcaagagttcaagaccagcctgaccaacatggtgaaaccccatctctactaaaaatacaaaaattagcttggtgtggtggcacatgcctgtaatcccagctactggggaggctgaggcaggacaatcacttgaactcgggaagcggaggttgcagtgaaccgagatcacgcctttgcactccagcctgggtgacagagtgagactctgcctcaaaaaaacaaaaaacaaaacaaaacaaacaaacaacaaaaaaccaatgacaatcttcccaaaatgagaaaaaaaaaatcttaaaatttgtgtgcaaccacagaaggccccaaattacccaagcaatcttgagcaaaaataacacggttggatacatcacatgacctgacttcaaaatataccaaaaggctagagtaaccaaaacagcatggtaaatggaataaaaatagacacatagactaatgaactgaatagagggcccagaaataaatccctgcatctacggcccactaatttttgacaatggtgccaagtatagacaatggggaaaggacagccttttcaataaatggtactgggtaaactgcatatgcacatgcagaacaatgaaactagactcctatctctcaccatatacaaaaatcaactcaaaattgattaaagacttaaacataagacctgaaatgaaactactaacagaaaacataggggaaaagctctgtgacattggcctaggtaaggattttttttttttgtaaaaaacctcaaaagtctgagcaacaaaaacaaatatagacaaataggattacatcaaactaaaaagcttctgcatagcaaagggaacaatcaatagagcaaagaggcaacctatagaatgggagaaaatatttgaaaactctacatctaataaggggttaatatccaaaatatataagaaactcaacaccaacaacaaaagtaaacccatcaaaaaatgagcgaaagacttgagtagatatttctcaaaagaagatatacaaatggccaacagataaatgaaaaagaagatgttcaacatcagaaatcatcagggaaaggcaaatcaagatgacagaaattttcacctcattccaattagaatgactactgtcaaaaaatcagaagataacaagtgttggtgaggatgtggagaaaagagaaattttacactctgctggtgggaatataaatgagtacagccattttggaaaatattaatagtttagagtttcctcaaaaaataaaaatagaactactgtatgatccagcaatcccactactgtgtatacatccaaaggaaatgaaataggtacttcgaagagatatctgcactcctatgtttattgtagtaccattcacaataaccaaaatatggaatcaacctcaatgctcatcaatttttaaatggatttaaaaagtactatcacaagggaatgttattcagtcataaaacaataaaatactgtcatttccaggaacatggatgaacctggatgacattatgttaagtaaaataagtcaggcttgggaagacagtgcatgatctcactcacatgtggaatctaaaaagttgttcttgtggaagtagacagtggaacagtagttgccacaagatagggaggttagggaacaagtggggataggagagattggccaatgggtgcaaagttatagttacacaggaggataagttctggtgttctgttgaatagcaggatgactagagttaacaacaatgtattatatgttccaaagagaagtttttgaactcattacaagcaaatgataaatgttatcagaaattgactttttaaatatgagactataataggacctgataatatcttctaataaatgaatataggaaaatcaccttgatttacactaaaaaagacaatattaaacaaaggtatattattgggaaattctctaaaatgctcaatgatggctttaaaaatagaagtttggggggctgaggtgggcaaatcatgaggtcaggagtttgagaccagcctggccaacatagtgaaaccctgtctctactaaaaaaaaaaaaaaaaaaattagccggacgtggtggcgggtgcctgtagtcccagctacttgggaggctgaggcaggagaattgcctgaacctgggaggtagaggttgcaatgagctgagatcatgccactacactacactgcagcctgggtgacagagtgagactccatctcaaaaaaaaaaaaaaaaaaaaaaaaaagaaagaacggagaatattttttaaatattctcctatttgaaaatagaatttcttaatacttttgagttcaaacaatggaagtaaagagatttggtcaccaatttaaaaactagtttgtctgtgtaattacaatttcttttctctctgagtgtaaacaaaatatttaggatcagtttattgcttgtaatgtgtcatcatttctctctttctttttttttctcacccatttaatttgtttactcttttttcccctgtgtttccagcaacataggaggatttagaaacaaaactgtcttgggcagagggagatgatggcaaatggatgaaaaactggcttcttgtttttggtggttactatagcaataatcatgatgggagatttttagccgcaagtggtttctataacaacatgatagggtgctttagaaatagacctgaggtaaacagattctttaagggcctcttaaccccttttatcccacaaaattagcatcctcttggaggatgaatattagttggcttatttgatgaaacgcttaaaatcttgcttttgttttgtaaagattaaatggttaattattctataaagacctggccttagccaatcagctcttaggctccttcacttcaggaaataattgatagcatccctactttatttctgcacagcaaattcaaatagccttaaagatatgcatttcatagtattcaccaaaaattggaaaaccataaatagtcctcgtgagaaagtgtgttcactctgacatagatcactcaagggctcttgctttactaatacttcatatacactatgatttcacctattgggctccctgacaggtggagcttttcctactctaactaatggagtctgaatactcatcctttattaggctattcagtgtgtgccagaatagacctggtccctattgagttataattcactaggtattacatggggaagtttagtaattttttgaatttattaaattttagtatcataaaaactgacatagaaaaaagcaaaggcctccatttcatacataagcatccttcaggagcccttataagtgaaagatcaaggggaatttatgacaggaatgtggtacaggagtagatggtggtaggcaggaaataatttttcaagagaaagaaagatggaaggcttaaatttagttaagtagttaaacagaggaagatggggatcaagtttggttgactttaatagtgagttattgattatctactctatgttgtacactataggtatatacaatgttgaatagtatatgggatttattttaaaaactaaattatcatatcaagtaaagcactcttattaaactattaattaaattaattgatttgaagtggccatatatttacaagaatgatttcatttatgttatgatgtctcatgcattttctacagtagagccatccttatacttttattcttttctattcagttaagctgccaattcaaaacatcagatattctctttcaaatctcagaaggatgtcagcaaccatgcatctccttctctctgatttcaaacagtacaagctattcccatttccctggtgttttgtgctcagcaatgaagcctcggaattcattacgtaatcacttgccatagccttctggggtggagtttgccaaatggatccctgggagatcaagacccattctccatgtgtgccatagggctatgcacatgagctgaggcatgtctgtattcaccaaggccctgctcagaacagcatgtgccagaatacactgggcaaggagccattcataaattcttgaaaaatcttatccagaccaaaggcacaatggcattgtagttgttgtgctcattgccatggggcttttagctgaataaaaagaaaataaaaaatatattcatgatgacttccaagttatccagtaaccacagtaacctaggttttccccaaatttggtccacaactttgagtcacctgacagaaacaaatcattctgtctttgttcaagcatagtgagccatagagtgagtgaaacaaatttccctgggataaaaaccaatgaatcagcaaagcaaacaatcatcatatatttattttactattagaaggtggtattcaaaatgtcatcaaaaccaaatacatacctcatacatacaggcatactgaaaagcatatattatagttcctgaacttaaagagtttgtttgctaattgtaaggacaagtcttcatatatggcatgaagaacactttaggttgcatatagataagtgttcaattgtatcttaacaataataaattctgtggctgctcaggccaggagctcaaggggtatgtaaaaatatgaggaggattaatgggaaaagtacactttgcattggacttctaacaatttgaatatacatcacagttaaactctcagaaagtattctgagatatttttattcatggctactataagaagaatgtcataaagaagataatttaaattctggaggaataatgtcttactcataaccacacattatttttctagactttagttctctgtacaaaaatgcgagaaaactgttgagagttgcactatccaacacagtagccattaatcacatatggcttttgagcacttgaaatgtgactaaaattaagtgtgctagaagtgtaaaatacactaaggatttcaaaggcttaatgttaaaaagtgtaaatatttcattaatagtttttacactggccaggtacggtggctcatgcctgtaatcccagcacattggggggccgaggtagacagatcacttgaaaccaggagttcgagacaagccccatctctactaaaaatagaaaaaattagctgggcatggtggcacatccctggaatcccagctactcaggaggctgaggcatgagaataccttgaacccaggaggcagaggttgcagtgagccaagatcgcaccactgcactccagcctgggtgacagagtgagactctgtctcaaataataataataataataataataatttttataccaattacatatttaaatataatgctttatctatatttggttaaatatttaaaattaatttgcctgtttgtttttcgttgttaacatggttacagaagacttaacattccatatgtagctcacattatacttccattagacagcactggtataggtgcttgctatttaagtgtagtatgtggaccaacagcatcagtattacttaggagcttaccataaatgccaagtctgaggccccactcctcctgactctgcaaggttaacaagatcctcagcagttcatatgaacattaatgtttagaaaatgctgatctagataatgttttagatgtttctttttatgactctgtcttccttttcatttggatttttttcaaataaatattttacagtctgggcatcctgacctagcacatattagatgcataaacttggggaagttatctgacattcctgaaactcaattccatatttataaaatggatgtaatacctccaatcccataatttttctataggggttaaatgaaacacaagaattatgaaaggaaccaataaattggagaaatttttataatatcaaaaataatattgaaaaattagattattctaattattttcattcttatattgattgccaatactattttgatgtacagtggaatgaactagagttcgaagggctgttttcatttattttacaaatgtcacttttttaacattaattgtgtataataaaacttagcacactgataagtctctagtagagatattaaaacttttggatcttcttttagaacaaaagtgttgtgtagctaaattttcctgcaccatcattatataattgacattgaaattatatctgttcgttgatcgattctgcaaaacatggctttatggagcgggaaaaaactttttcgtctttgttcagaacacttttagctttactgtgagaatttcaatttgctagaggcaaataaactagtaaaatatgtctattccatagtaaaaggggtcattcaaaagcctgtccttattaaaatatacattgattataataaggtcagtgatttcaggcctgattagctttaaataaatgtaatgtcaaaggaatataattagttcctcattaaaatttttcatgattgacagtgagtaaaaatgaccttcacaacttgcatcatttagtcatgttctaaggatgacaaagggcagggcatcttctatgaggtaaatgtgtatgattgcagcctgaggcacatgcacttggtcccttaccctacctaaccctaacgcccaagacctgatccaagccagaccctgtgcttaggtgtgtaggctgtgtaaaggaggacccagaagctttgattctcatggggatgctttgagagaaaaagaaacctttgaaccggcaggacctgatttcatctgtgatgatgctgatgatcagaaattatatataaaagcaaatagcaacgtgcctatcagatataggggatttaaaatatgttgacagaaaactttctcagtgaggccactgaccttctaaagaggagctaatagtagaatagggatattaagatacaggtgatgtcaatgaattttggccaaaaccaatcttcttacctggagtaagaaagtcgtgtttcaaggagtttgcatgagtattaattgtggttgatgatgatgggaacctgccctgattattaggtatgattctcagagaatgtgtgctggtgctaagcttgcatttctcagaacccccaaaactctctttgcaatattatatagtttcattttcttgaacttattcatttgttaaatatgcatttactaagcaccaactatgtacatggcactctgctagtcaatagacaaataataagatatatgtactttggaccctgcattgaaagaaaaagcaaataatgttttttaaaaaactactttatgcttgattgttataaggaactttatgtgtattatctcttttattcctaataataataagaacaaggatgattgataatgctcactctgtgccaagccctgttaggcattttatgttcattaatttaaccctttataacaactctatgagataggtgccatttttacaaaaatggaaactgaggcagagcgatgttatcttgataaaactcatagacttagtaagtggcagagccaggatttaaacccaggcaccaaacttcatgcgcttatccactatatatatggctccacatcattttctttagtaatcaggacactgaggctcagtgaaaatgttttttcttaaagtcacagagatggtaaatactagaaccaaaatttaaatctctgtctaccataaaaatgtcctcttctcactatattaaattggcctcaatttagtatttaagacaacgtgtacagtaggaatacaaaggaaaaatggtcttaaaggagcccatctacttcttattttaactgctccatgtggattctatcacgcagtacatcaaagtaagtgatttaaccaatcatttgttctgcttgattttatcaaaagaggtcaaagtaagaatttcacagcaaggcttaaatgggaattcaggtttccttgctcactcattcattattcaacaaatttctattgactgccttaccatgtgcaagccattttggctatgtcctgattaaagatgtgcccctcctgcaccgcctccctccccaccccaatcctggaactaaatttcattctctgcagaaagccaggctaaagagaattcagcaaaccactttattctcataaattggcattcttagacctggaaattttgagttctatctccagtagcattgtttataccttctatttcattctgattacatttcattagcaaaacatagcaaatgtttataaaatcgtcagtcttctaggtgaaacgatgtaagacaccattcatttgattttttggaaatatcaaattttatgttcacaattcctctattctactctgattatttaggtaaaattaggttaaatatagataactatagaattaaaatttaaaaaactgtgcctttacacgtttggaaaattactcaattttttttcaaataacgccaaccatatatattgaaaataacattattccataccacaggtgacatattcttttcctatccctagcagcgacttccccaagtccctgcttgtctcaacagtttgaggaaaaaaaacaccagaaatatacatgttccagaacaatgaataaattcccaaataactttatatacattagtgaggatacaatgaggagtgtttatctagctaaatatgaggcatattaaaaattgctactttaacccagatatgagcaataataggagttttatctacgcctccttcctttccttctgctgacaaaggatacatttaattcttgacgttaatatcagttaaaatgagatctagagacagatataattagagagctagggagagaattaagttagtaaatcttaagaaaagactgagtatactgatgataagaggatatttaaatagaattttgaaaaagatcaaggatcaataattatacatttaaatatacatatatgtatgcatatacatatgcatagttttacataaagaaactattaaggtaagagctatggctttgacagttaatactcaagaaatatttactgagcacttggtataaataaatagatatggagcacaatacaaagatacagcagatgctctgaacaattaagtccttatcacaactcaaattccatagctagcattttgctgagccaagaatttaaatggtacttaaaatttatagaggccggggactgtggctcaagcctgtaatcctagcactttgggaggcctggatggctgaggcgggcagattgcctgagctcaggagttcgagaccaccctggcggcaacatggtgaaacccccatctctactaaaatacaaaaaattaaccaggcatggtggtgggcttctgtcatcccagctctttgggaggctgaggcaggagaatcacttgagcctgggagatggaggttgcagtgagctgagatcatgctactgtactccagcctgggcgacagagcaagactctgtctcaaaataataataataataataaataatttaaaaatgtataatcagatgttaaatattttcttgcaaaaaacaagggagctggggaacagaacctttttaattcaatttcataattatttttgtccgatcctgaccattcccaggtaatttacaggaagggcatagttggcaccttgaattagtccattgttaggctttctatgtaagggtactcgtgtttttttgtttgtttattttgtttcattctctttcttaaaataaaattccttcagtgaaaattattagtgacttgtacctttttaattatttttattgctatgttttgtacttgttcagtaaattttctattaagaactcaaaactatttctcaacatcttataaaggtaagagctagcatttaccaaacacttacgatgtgtctgcaaagcatttaaatttagtgacttaattctcacacaccaaaaaaaaaaaaaaaaaaaaaaaaaaaaaaaaaaaaaaaaacagaaaccaaggctgggagaggcagagcaggcctggtacccatctgttgccccttcccactgtattatcctgactcgctggtaaatctcctatgattgctaaatagaaaagtcaatgaaaagattgataataaaaaccactgaatacaactttcagattcttgattgatgattttaaattagagaattacctgtttcatagaaaagtgcaatagaactatcaaggacaaaggaataaatactacttacaatagagaaattaacatgttcttccctgaaagtcttgcaccttgcactgtttcattgctctaaataaacatactcggcctcataatgaaacaaaattaccaatatggctattttccaagtcaatttaattattagaaaatacatacacacagatgcatacacacacacacaagaaatatatttactgttatttgggtcttcatcttccttaaaactggtcaaatttgtttttacttctcagcagacaaaaaaactttattttagcactagaaatacttaatgcaaatatagaaataattgcttatagtaactatataaaatcttttcttttctcttgtgcagaggttttcaaattgctggtctcaaaccctagctccttggaggtgtctctaggggaggcaggagactggtctgactgggctccaagggaccttccctgcttcgacctgagcagatctgctttccaattgtgtacattgggattcctcatgacattttccttgaaggaattctgctgctcttaaaaagaaaaaagaaaggaaaagagggaaaacaaaaagtctgaaactcacagtggtagaatttcttaaaacagccagtagatggcaaactttactgcaaggaaacaattttgcagcctatataatttggtctgaaaatagcaattaaactctacatccagtaaaatttgctatcctgtatataagtcttctgttaaatcaggaaacaaaattctctatggtactttctctgggaactaaatttcaattataatttaaaatatcctataacttctttctgtgtccatttaagtcttgctctgaaggtattatcactatgaaaattattgcattgttcactgaaagtacatacaatgtgctaggtatagtaatgtagatgacgtagttttttcattaggatgaacccaactatgtattttattaatgagtttggttgaggcagcacaaaggtcacaaagaaagatttttaactttgtcctcatttataaatttaatcttgttactttttatttccttgtagattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtaagtgtgatcatatctgaatcacagatggtgtagttagctctttctaagtggcagaagcagaggtgacattttatttttcacacaatcatttatgaaaatggccaagttcttgacaggaatcaatcactagatagaaactccctaaactgctgaaaatccactgaatgcactgaattctaagtggttgcctgctgtcactgttgctgttttaaatggagctctacatgatttaaaactggattcagtctagaatgaatgaggtccaagagaaactcaagggcagttcaggtttcctcatcagtgcatgttcctttcattccagttcaagcctgctttctaatccccaaagcctggcactgcaaccttctgggaaggcagtttggaagttgatgggtttctagtgctgacttgagtattatcaacagatcagtggtagtaaagctgatggagcatggtatatcagataaaccacgatttttattaagaaaaaaagcctgttcttgttttacgtcttagagcaaacaattgtacctcatatttatctatctattctttacaatgtttctgttgatagaattttattttaataataaagtaacaagttgacaactcatcattaccaagttacatgctattcagcctcttcacactcagtatttatcctccctatccttttgaatcactgttactgttttaggtcaattcttcacgatggccacatttcttgctttgctttattctttggcttttccatttacttgtaagggggtaacttacctagcctatgctttctcacatgcattcattctaacttctgctcaccactttcttacagttcctgactcatatctctaagacaccacacacattttaataccatgttctcccttagcacttgccgtttttgtaccttcctgaaagccttcctgaggctttcagcttttaaacttgccttcttctcccaacactttcacacttagttctttattttgtcattctttttccaagtgttaagcaatatatctatttggaaaatatttctcttcaaaatttgcaccagaaccctccagcatcattttacttttaaacattctaaaactatatattttataaaatagacacattcctagttgctctaaaatgaaatttttcccctctccctcctcctttacatacaaccagtcttcagaatctgctgttttgacatctaagatatgttccaaattgagctcatccattcttttccttggttaggtttatttcaactcttgtgtgtactactacacaacctcccagacgttctacttatagcttctaccttctcgaagttgttctgaacactgcctttgaaataacttttctaaaatagacctatgccgtagttctgaagagccttgagagcttcccactacacagagaataattttagcctctccctgaaagcacttcacaatttgggcccatgacagtggccatgtcctcacacattccaccgaagccttctatttcctctaataaatcttcttcatttcttatacaagtcatttctttccccctggaatgtccttcctcacttcacaatgtctactctgaagttctgctatactttttaagacctagttcaaatatcacccaacacaagaagtgtttccaggttcctttccagctggaataataattccacactgctgcagtaattatattcattatgtttgtactagttgacacctgtattaaagaatcccctataattctttcctattttacatatatctatgtttttgcacccccccccaaatgttagtttctaaaggacagagtattgttttatatttattctttaattcatcaatactttctgagtttctattagatgtcagttagtggattaagaagaggagtcctcggccaggcgcggtggctcacgcctgtaatcccagcactttgggaggccgaggcgggaggatcacgaggtcaggagatcgagactactgtgaaatcccgtctctactaaaaatacaaaaaattagccaggtgtggtggcgggcgcctgtagtcgcagctactcatgaacccgggaggcagagcttgcagtgagccgagatcgcgccactgcactccagcctgggcaacacagccagtctccgtctcaaaaaaaaaaagaggagccctcttcctccaagagcctgactcagtatttgtgagtaatggctgcttaatcaactgttactaaattgttctaagttttacaattcttccatatatttctgggcacccttccccatcctgaaactcaggtaaatgaatattaaataagaattcactttttgtattattttatgtatactctatgatgctaaaatgcttatgtcaaatggaaaattattttatcaagtgacttaattgtcaatactatctaaaagttataggaaatattttaaaagcttataaaacaatagttgtatgaaaagctccttgtttgtatgccatactgaggtgtctctttctttggtggagttatggcaggtgaatttcaatattttttaaatttttgaataaaaataagaaatttttgtggggctggcttggaagtgctttgtttacaatggtcacatttaaaaatcaatacagttcattaagatagtgtcttccattttctgcttctatctcaatattgtgaatggtgattaaaaggaatagatataaaatcaaattaatgtttcattcatttcaactatagtattgtgtaatagtcttatatttgtaaaaaaaacacagcttgcaaaactatattttacaatgtatgttttttaaatatcttaattaaattggattttaatgaatcctttcagtcgtctaaatttaggcataaaagatggaaagggtggccaggtgtggtggctcacgcctgtaatcccagcactttcggaggctgaggccggcagatcacgaggtcaggagatggataccacactggccaacatggtgaaaccacatctctactaaaaatacaagtcccagctactgggaggctgaggcaggagaattgcttgaattggggaggcagaggttgcagtgagctgagattgtgccattgcactccagcctgagcgacagggtgagaccctgtctcaaaaaaacaaaaaacaaaaaacaaaacaaacaaaaaaaacagctagaaagagtatattctaaatgtgaaatgtagtcaaattccatcataaggcacttcaccttacaatgaattcatttatactgtaggttgtatcacatccctgtagggtccaatgggaatgagtccccttttctcactataacacttaggtccacaatgaggatgctttccttgtcaatccctgatataatagtgttgttccctatttgactatattcttcccttgttttctatgaaatcagctacatgttattatttcaccttttcaagtgacatatataaaactttcttgaaaacagaatttaaacaagagactcataaggcagataaaaatcgggtctattattagctggttaggcttgttcgggtaaaaaaaaaaatgcagtcataggcttgctcaccaatctcctacacaagtagaatggcctgtgttctagtagctcatgggtgtttctcagccctgactactcattagcaattacccagggagctctgaaacagaggtgctcagactctacttccagagggtcaaatttaattgatgagtctaatgtatagccagggctggcggccaaatattaagttcatgtgagctttatttggaaatttttcttgcaccataccatcatttagacacacagggaagtgtgtttatttcattgctatcccatgaccaccagtgtttgtggcagcccaggccaactaacgagaaccccaaagaaggtctgtagaaccaagggaaaagccaaagttgagaaggaaagaaaaaagaccatcagcaatcagcatggatgtgctggagtgctctgcctcaacttagacctcctgatgaatcctggaaactgtattacaatgacctagctgctgtgcaccacatccaaatttagagtgatcataaagaactcctcttacagaaaaaaacctgtgttcctctgagcagcaaagtaagaaaaggtaataaattttaaaaggcagagaggtagaaggggaaaaagagctgtagcacatagagagggttcacactgcgtgaattctcctctgtgcactccattatgcttcatgggcagtgattcatgaactacagaaatggtctcagagagagccactgaagaggctggtgagaatctgctgtgcataagcaaaaactccaattgaagctgaaagtaagtggatgcaaacttttttaatgaaaagaatattagctctaagcatgtgactgcttttagttcaatttcatgcaatgaatcatttcataattgaggccttctttaaaattagccagattgattaatgtacatttttctcattcagatgcctgcagtatgagaaaaatagggctgtaagagggcagagaaaggccagttcaatgtatgttgaaacaaatcaatgtagaaaaatatcttattcctctattacaaaatagatctttggtataaaagtaatcttttgggaaataagaaaatgcactatattcaatgtacttttcaactatatgatgaatttccttgcagaaataaaaatgtacaaaaattcatcatatagtgaaggaaatgtatttgtacttacagagtagttagaagactagttagttcatggagactagttaggaggccattgtgataacccaggtataaggttttaggacctggcctgggagagtggccatgggcatgaaaggaaagagaaagtataatgtctctagaaacaagactcacttaacatttatcaaggtcagagtattttcaaacttattgtatccaaggaaaacttgaaaactctgatatgaaacaaatgcattaaaagtttaactggcattgtcaacttaataagcttacaatgtagatcaatgggtctcaagtgttggcatgcatcagactcacctatacagcttatcaataaaatactgttttcagttcaacagatctgaggtgggggtccaagaatatgcatttaaaacaagttcccatgtgatgctgatgctgttagtttggggactacactttgagaaccactgacatagacagttatgtggatttccatgtgacatccttgactgttatttcacaaagtccatgaggcaaggaaacacaaatcaataaaagcaggcttttatataaagcacttattgctagtaacagttctaggtacttgatgatatgatttgagtgattgcctcctccaatactcatgtgttggagacataatcaccaatgcaatagtattgggaggtgggaactaagaggaggtatttaggccatgaggatggaaccttcaggaatggattaataccataataaaaagggctttttggagtgggttcacccccttccactcttatgccatgtgaggaacaatgttcctatcctctggaggatgcagccttcatggcaccatcttggatgtggggatttaccagacaccaagcccactggaaccttggtcttgaacttttaaacatccggagctaagagaaataaatttctgttctttataaattacccagtcctatatattctgttataccagcaccagatggactataagacacatgatatggattttttaaatatttgtcgaattcattagatcattaatttattcaacacatatatattgagtacctcaatgaattgggcattgttctatgttctgaaaatgaaagcgtaaagagaagtgatgacaaagtctcttacattctgcaaggaagagatagatgtctataaaacaagtaatagatatactgtatatagtaggttagagggtaataactgcatggagaaaagtaaaacaaaataatggtattagggattaactttaggtagaatgatcaagaaagtcttcactgagaaggtgacatgtgaataaagttctaaagaggagaggatgggaaccaaggaaatgtcttgtggaatagcattccaggcagaggaacagcagatgcaaaggccctgaggtaaagagtccttgcaatgtttgaggagcagcaataaagttagtgtgactggagtgaaggaggaaggagataggtcagagcaataatgaggtcagactgtttgggaccttgtaggccattgtaaggactttggcttttactttaagtgagatgggatgttattggagagttctgagcagagaactgaaatgatttgacttacattttaacaaggtcactctgcttattatgttgaagatacactgcagggggcgataagcatggaattcaagtgtctaagggaggttaatacaatagtccaagaaaatccactccttgtgggagagaagagtgaaagagacctatcaagttttttgtttctttttgttttaattttttttttcagatggagtctctctctgttgcccaggctggagtgcagtggtgcaatctcggctcgctgcaacctccacctcccaggttcaagcaattctcctgcctcagcctccttagtagctgggagtacaggagcgtgccaccacgcccagctaattttttgcatttttagtagagatggcatttcaccatgttagccagggtggcctcgatctccggagcctgtgatccgccgcctaggcctcccagagtggtgggattacaggcatgagccacctcgcccggcccctatcaagttttaacagtaactttctcccctccctgttccacccttaacatttaagatggaaattaacaaagaaggatcatggatcatgcaaacaaaatgaaagcatgcctttctctctctgccctctattgccctctgatggcaatgtctagattattcagaacaaatctgtcctttagaatattctaacaagaatgcagtctttcttagtagcttctgtccaccatattgccatgcagtgtctttcacgtacacaactgcaacatattttacctccctgggttacatgatggttactcatttaaagtgtcctatcagcacttcttttacttttaatgataattcctgttcctcttgggccttctccaatagtcctcatccatgctgatgcataagtctaagaggtatgatgtaactgacactgccattacagtggcacatatcaaagacataattcgaatttcagtcgttgtggaggtttgaatctgggcttggtgttctatcttttctaaatatattttgatcaactaaatcactttgaaggcatctgtggcaaataatatagataatttaatggtcatgggaaataatttgaggaaaataaaatatgttattaaatataagcttatttcatgagaaataatattattatatcaaagaaaaatggttgtttttatatgcgcttaattatgaaattgataatgttttatggtgtcttataaagaaaattaaacacttgttcaggcttttgctcagaactagagtcatttgaagtagtttttatgaataaatgaagtttccaggttttgacaaatgtttgttgaatgagtgcacaaaataacaaatattcactcagcaaatacttatatttgcaatgcactgggcattgtgcggacttcggagatgtaaaagtgactaagataaaatgtattcctgacaaaatgctcacaaattattctgggatcaggaatgtaaacaacaattaccatctgtctataaacatcatgctgtggaagaacaaagaaagaagctggtaatgttggttggagtcaggaaatgttcctaggaaaaaaaatggcctatgagtagagcaaaaatgcatccctttcagaatgtaaaactgaaacttgtatcttcctcctacatttactattattatttgaacaataacatgttgaatatcaagggagaaggactgcagagatattttggaaaggtgttgctatgatctgaaaagtttggtccttccaaaatgtatatgttgaaatgctgtccaaggcgatgaaaaggtgaggcttttgggaggtaatttggtcattgcggggaagctctcataaataggctatgtgcccttataaaagaggtccaagagagatccctcaccccttctaccatgtgaggacatagaaagaaattataatctatgagccagaacgacagctttctctctgacatgtgactgctatttctcctagtgcctacctagttatcagcagggtgtgtgtgccagtccgaatgcaaaggggatgagccaaaaaatatatagtaatataaagaacggatgtggtggaaagacaaatttggaagtagaagacagggattccaggctcagcctagatgttctctagtggtttggtactgataaataacaattatgaacttccatttcctcattcaaagattggcatggtaatacaacctaacttttagggtcatgatgagaatgaaatggattaacaaaagtttttccatagactatttaggctatgaaagagttaattgccaatatttctgtctcttaaaacattgctactaatgaatacctatggtatctaaacaatgtttgcctttgttttttacaggtatcattttcttatatttgaattgcattcaagtaatcttatacctgattacttgaaagtattattttttgaatactgttagaacccaactcaggaatagattaactgaagttcggtcaaaatctctctgccacacttataaatttaaagtgtaatattttaatatgtgtaggcaagaattcaacttctaaaatggccatatcataaaataaagaactaagaaattactactattttaacaatttcatatatttaggaatagtaattatcctaatgaagagaaacataagaaagtaatttgctatgattaaaacataattatggaagtacgaaaatatataatgtttaatactgatgtatttaacataaaatgagaatgttgtaatttttctataatctttcaaaaaaacataaaattaaagcataaaccattcataaaagtagtgtatttttcaaacatagcatcttggagtctctgaaatgggttactccagcttttaaaatttgatatatattttgctattttcataattcttttaaaaagtgtgggtgtatatatatgtataaaatatagaaagtgtagggggaaagtcattcgtttaacttgggaaaataatatattactatcttgtaaattttatgatatttatgatgcaagtgaagtgggagaaatggcatacagatggatttagagaaaaatggctggagaagaggaatgaagaatgagctcacagaattagaagaaactgttctccaaacagacaactgtaatcattagatacaaggaagtaggagaatttcctcccaatgccccactcctagggctgacaaagagaagacattctttctcttcctagaattagtttcagcctccatgatattctgggaagatggttttgaaactgtcaagaacattcttaaactttcactgatggtaaaatggtaccaaagaggacacaatgtgaaaaggattaagaaaacctgaaaaaaatgtttaatatggaaaccacaggttattacagttttgtctagcagtaaagcaaaacttgtagaaacaaaaaggattataatagtcacaataacaaaataataaaatataatcaaatagttaaataaaataatgacaaagcattaataatatttataaagacaaattttctgtatcatcagatttaatacatcatcagtcttacatacatttcagatatcattaagaaagaaaaattatttggttaagttgtaacaagaggctaaggcactgctgattgtaaagtgcatctcggttctagagagttaaaaatgtgagggagtaaaaaaggagtcagaattgacaaaattcggcagtccttcagagatagaatcctgggcttgtaaaatctgctttaagtgaatgattcaaaaagagaattttgttatttttggtgtccttaggaaaggtgtgtctaaattcacaagccagaaatctcattggctaaaacgccaaagatgttcccactgaaaataataattatccacgtttaatctcttacaacatcttgctaaacattgttatgcttatgttattaatcagagcaggaagtcatccagcctctccttattgctttaggatgttaaacagattgactataatatctaggaggagaacttactgtaaatctatcactataatgaaaaccgaatgctacagttccacattgctctgatacttgtgtcaccgacttgcactgataactgttgtacttgatatacataaaaagccccaaaatagcatacataattattattcaaaagaaaaatattatgcatagaggcctgttaggcatcacatacattgaatggaatttgaaatttaagatgatagtctgaagccagactacaattatttccaaagcgtggactctgcagataatgagaaaggcattcagaatggtttatcaacaccttgctgcgtgcatggtgtgctccctgcccactgtaaagaatgatgaagacagcgtcaaagtcaagacctgttccatcctgataggatataatgtccattatcttgtggcacggaatcttaacatggatctctaaatgccgaaagatgccaattggagtgcaaagtctctaaatactgatcacaagtttggggcacaatcattctgaaaccataataggttttaaacatttgccaaagccacaaatttgacttttgggcttttgatttatggcttgtggaagcactgagaagctctgtttggcatacagtttgccttcctgtagaggtggttgattattccatagctgtgacttgattattcatgcattcaacatttattgagcactttttaaatattcaagaatatgtgctaaatgccacagatattggtgttaaaggtcaaaggccctgacctcaaggagctcacaattttgtagataaaatagaaaaataagcaattgaggacaatatatatagacatttatattaaggggaattttgagagcacagtgaagcagcattagaggcaaatataagtaactatagtttccagaatcatgggatacacaaactggatatttgggaactaactggagctagcctggggaaggagggagtgaggagtggggcattacaagtaagggaaatacctatatgcagcctggagtcttgagatacagtggagctgtgaggccactgctgtgggtggcaccagtagaatctacatcttttagaagcttctactgcattacaaggcaattatgctttatttcagagacagggagatagagaggggatgatgtcaaaaatttaagcagacgagggtacaattatatttgtactttatagtgatcacatttctatagaaatgtagagagtgattgcgaaaagagaagtcaataatagtgagagcagatgagacatgatgagggttgaattaaggtcacagcaataaggatggcaccttagatccatttctaagagagagatgatgagatctgatgactaattaggacacggggaatagtggcaaataagatgataactcctagaactatggcttggatgacctggatgataataccattcactgagaggagagttttggcagggatgggggtggcgcaaatcagcacaggtggggagatgaaggttatcattatttggaattgtggaatgatgcctgtattagtccattttcactctgctaataaagacataccctagactgggtgatttatttaggaaaaaggtttaattaactcacagttccacatggctggggaggtctcgcaatcatggcaggaggtaaggaggaacaagttgcgtcttacatggatggcagcaggcaaagagagagcttgtgcagggaaactccccctaataaaaccatcagatcttgtgagacttattcactatcacaagaacagcacaggaaagacctgcccccatgattcaattacctcccacagggtccatcccataacacctgggaattcaagatgggatttggatggggacacagccaatgcctgtgagataactcaatgccattgagatctcaatgcctgtgagataactgaagaagacattctagacggtatcaggaggatgatctgggccagacgcagtggctcatgcctgtaatcccagcactttgggaggctgaggcaggcggatcacttgaggtcaggagtttgagaccagcctgaccaacatggtgaaaccccatctctacaaaaaatacaaaaattagccaagcatgatggcatgcgcctgtagtctcagctacttggaaggctgaggcatgagaattgcttaaacctgggaggcagaggttgcagcgagccaagaaagcaccactggtggcaaagtgagatgagtgagactccatctcagaaaaaaaaaagaaaagggtgatctggtctggaggtacagaatgctaatgtatatctacattcgcttatgtgaaaacgtcacagggaaaaatctttctgacttctgtgagaatgatcacctgtttctctacctatagtctcttctcaactacgaatagataaaccaaacattttttttcccaatgcacctttaatcccatggcttttgctgaaacttggcatttattcaatgaaaccactttccacacaatcctctttgaagagtccttatctccatgattcattcttaaggccaagagggaaggttggctttcttgctgaaaccactgttcccatgagtccactagtgggacatttaacttcagttttaaaaggatggcttccttgggtggacaagggggaaaaagcattccagacagagatcagtgtatacaaaaactttgagtggtagaggtatatggtaggtttgaggaaaagcaaacagtctggtatgacatatgactagcatgtagaatgatgacagaattttaataggagccattggaattgtatggaccatgcttttggaattctgtgagcttcttattctcagtcaccttcatctttattccactgcagccatacattgatccaatttcaagttagaccctggcgtcattcaaacctgctttacaacagaaattgtcaccacatcctgaggcttctcatttcctttctactattgaatttttagcagaacctctgtcgcctggcctttccatacccatactctctctcactccttctctatcttgacatctccccaacaatcatggacttaatgagaagcatctcaagaatgtgtctgtcattgctctctaaacattcttgtttttgaccttcaactttccagtagtggaaagccccattttctaccttcttctcgtctagctgtaaagctattaatccacttcaaatatttattacctaattttagctatatatttgctattgctttgtggctttttctacattaattgttgatttttttaaatggtatttgacacgctggctgctccaaatttttccagtctctatattttatactcccagtaatgtcatttatatttattgataagtgaatttaaggttattctaaattctcttttagagttgtctttgcttccagtcacttttcaaacattttttattctacctaccctgaagaattaagggtggaatgcaggaaatgacaaacacactatagtaatacctaccattgatgtagcatttactgtatccaacctcgttgttagtagtgatagagcagagctcagtcctggatggtctgtcaaaaaaatttatgttctttccactcttccatgaccttagttatgccaagtaaaatagccatggaaaatctcattcacagactgcagtagaaatagctaagcctcaaagagcaagccacttacctagaaacaagtgctattgcaaaaatttccattttcaccgacataaatttagagttttttattttttaaaaaacaatcaaatttaatatgctagcttctcttttaagttggttatttgttgaatctagtaacagttgtaaataatagatggtgttagaatatcctgctgcattttctgtagagaaaaatgggcacaaatcaattgaactactactgacttctgagttttttgaaagtcttttaataccattttaatatataatttattatttggggttagaaacaaagaaataaagatggataagtatagatattcttccttttgtgtcttttaaaacctgtatgcaaatgcaattattgcatatcaaatactattttggcacttaataaaatagtttgttatttaaatactactacaacttgtataaatcataaacttattttgcttagcaaataatacctactaattttggggggataagtacagtttttttttaacataacattaccttaaaatgaagtgttaatagcttctaatgatgccattaattacattgtcaccagtttttgtatttaagggtagtattttacaaaaagaaaaattaagataaaaatgtctatgcaaaatgagcacttagatcaataattgcacattatatttgtacaatagattttttgtggaaaaaagtgttttttctctagcaaatacttagtatgtatcaggtactgctataagtacttttgaacacatttaattagactaagagtcctatgagataattaccactatcgtctttttcacatgaggaagctgaaacatggaaaggctgagaagcttgcccaaggtcatacagctaataagtggctgtgccaggatcccgacccaactgtctggctttggagtctgagctcttacccactgttctctctgctcctttactaaattaagtgtttaaaaataatggaaaaacatcgaccagccacttttaggcttccaacaaaagtgcagttaacaataaactttgttctaaaaatgacttatttgttttcacggactaaacaccacaagctgttgtatgcaataattctttgtaacagctgctctgccttgtgcaacttcccacaagcacaccaaaagttaatatcaattacaattaagggggaaagttattttgggtaacagaacatttgacaagtgctctggtaaacaaagcattgtcaaattgctaaattatgaacactttgctaaaactttttctgttttttctgtgctgacttttttaaaaggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacaggtacattttctctggcgttgggtgattggcttagaactccctgaccatgaactattttaccactctgttgaatttagagctctcacgttctcggcttaaaatttggggtgtaactttatactttaactgatgaaaacattcagatttcactaaaaagggtattcttggagaccatctgtctcaagagggaagattttacaagtcattcttgtaatagtttagaactgcttatcctatggaaaatggccaatttttcaattccatgaaataaagctgttgtagataggaaaggtgcaaaaacagagctagagattattatatatgtgtacataagtttgtatctatatgtcaaggatataaatcagatgacagcaataaatccttttaaagtgttatataaaccatgttggaaaaggcagtgatatttaattacttatatcttgaattaatttccatgtgttcagggaattgggtgaatatttttgagaaagcataatggcgagaaatagccatgtgattctgcttcaaattgaagtctatcattggctttcaggcaaaatagaacagcaataaattacatctcaatatgatgaatataataaatgtgtgtaacagtaattgagctcatataaaacatttttaaaagaactttctaatacttatttaagccacgacactgaagaactttctaatctttatttaagccacgatgctgagttaccaaatacataacaatttttaacaagattagcacttaaaattatcgtttgattcttcgacagctcagtggaaggcaagataagtatttatgtttccatattacaataaggagtctaaagtttagggaaatgagaagacgcccgcaagttcacacaattaattctttgcaaaaggaagaccagaatggttttcctttatttagtaaataagacataatttatgccaaatctaatttcaaagtgaatcagagtcaaaaggagagcaataaaaggcacatatgcttcaaaaatttgcaaaaataatgacttttttttttttttttttttttttgagatggagtcttgctgtgtcacccaggctggagtgcagtggtgtgatcttggttcaccgcaacctccgccttccggttcaagcaattctcctgcctcagtctcctgagtagctggtattacatatgcccaccaccatgcctggctaattttgctatttttagtagagatagggtttcaccatgttggcgaggctggtctcgaactcctgaccgcaggtgatctacctgcctctgcctcctgaagtgttgcgattacaggtgtgagccactgcacctggctctcaaattttaatagaacaatgtggttgtacattctttttaaaatataacttttaattacattccatgtcttgcctttgacttttagttgtaccccaataatgctctaggggcataaatctacattcctggagacaggtaactggccaacacagagacagacaggtcacaatggaagtttccacacaaggcctcctagaggaaaaggaggcttacccttccatacttcactgtttccagaaagcatcaggacagaaacgacacaactttttgattccaatggaaatgtaaacaaggctgaaactttgctatcttttattctcctcacttgaatatgccatgaataatttccctattgtaccattatctcttattgcctaaatgttgagatgatagtcataagatcaatccaatataacctgactttatgttcccacaaaaatttaaaatgtttgctatgagatacattggaaaatcagaactgaaaaaaaaaaaaagaacttcttgcataccaaaggaattatgcaaatggagcttctaattccgtgaggtccactagtcagccagccaagccctttggcaacagggtttttgtcgctaatgttttacctatactagatttttagtaggtattttttaattgaacaaatggaatactgaatagatttctaacaacacatatgaagattacagtcacttacaatatttggtttggtgataaaaacacacacagccatagcgaagaggactctacctgccttataaattcatagatattcttttcccaagaccctcattttgcctaagctgagtgtgcaggtacattttttacaatactaaatccttgaggagaccccgacctaaattaaaagtctcctcttaataaaatcaacaactttcttcattagatttgtattttggggctatttgataattccagtcattccgttaataattagaaatagtaaggcctaaatattcttgcaatctaaaaataagagaacatcgtaagtcacaattcatttaataaaggcttttcctgagtttttcataatttatggtttcacttttcatatggaaccttattaatgggctctctgtataacagagtgccatgatggtataaatcattctctaccaccttaaaaaatattaacaattttattaagtgctatttagtagcaacatatttagtacttcagatatgtggaatactgtgtctattctttatatgcatacttaattgtcacaataaccttgtaatataggtactatattcaatttatgaatgaagaaactgaactaaatagtcatggtttgcatgaccctgtactttaaattttttaaagttaataagacattaatatggaaataaatcatgcattcagtcctgtatagataattccccagagtttttgaggtagtaagatgatgccatgggtcttgggttgatagacagttgaagaaacagtataaagatatctgatctcaatatgactaagagttgacatgaaaatttcatttactttccagatatagctgtaactgcacgggtagtggattcacagggacacactgtgagaccttgatgcctctttgttggtcaaaaccttgtcacaataatgctacatgtgaggacagtgttgacaattacacttgtcactgctggcctggtgagtgacaaaataccttccaccaattatttttcatttgtttagaatacacatatcgcttatagcaaatgaaatgaaaaattattgttgttaaatgttttaaatcaatttcttctagctaatattgtttagttttattcttcagtgctcacacatatttactgctatactaaatgttgtctgaagtaggttaccaagctgcccaatgatcataaccctctagaggaatagaagggaaaaatcaatggaaagatgaaattcagcatgatcttcatggagaaaaattcactggaagatgctcttttcttccaagatgttctcttatatggcaggaatatatagaaatccatgaaataatgttaaactattagaaacttgtattctcttaggcatttgtaaagagttatatttgttaatataataaaaagttaattatctataaaccataattaaagtttacatatagaggataattagacgagtatagaggtgatacaagaatcaatagaaaacagtatgtaacatttgtgttacattacaggccataggcaaatattgatgctaattttgcaaaacaaactgcctgacatacagctttgcattgcataacaacattttggtcaatgacggaccacatatacaaccgtggtcctgtaagattacaatagagctgaacaattcctactgcctagtgatgtcatggctgtcttaacattgtagtatcactcactatccatgggattgtggtggtccctcaggaagtattccaaaagaacgcattgttgtcataggagatgacagcttcatgtgtgttattgttgctgaagacatttcagtgggacaagatgtggaggtagaagacagtgatattgataatcctgactccatgtaggcctagactatggtgtgtgcttggttcttaatttttaataaaaggtttaaaagcttaaaaaattcaaaatagaataagatgtaaagaaattatttattgtttatttatttatttttattttttgaaacggagtctctctctgtcgcccaggctggaatgcagtggtgtgatctccgctcactataagctccgcctcccgggttcacaccattttcctgcctcagcctcccgagtagctggtactacaggtgcctgccaccatgcccggctaattttttgtatttttagtagagacggggtttcactgtgttagccaggatgggctcaatctcctaaccttgtgatccgcccgcctcagcctcccaaagtgctgggattacaggcataagccactgcgcctggcccataaagaaattattttatacagctgtacatgtgtttgtgatttaagctaagcattatttaagagccaaaaggtttaaaaatttgaaaaatttataaagtaaaaaagttctagtacactaaggttagtttttaagacagaaaattttctaataaacctagagtagcctaagcatacagtatttataaaatctacagtagtatacaataatgttgtaggctttcacattcattcattactcattgactctcaagagcaacttccagacctccaagctctattcatgttagtaccctacacaggtgtaccacttaaaaaaatcttttatactgtgtttttattgtaccttttgtatgtttaagtatgtttagatacacaaataccattgtgtttcaattgcctacagtattcagtacagtaacatgctgtacaggtttgtagcctagcagcaatagactataccctatagcctaggtatgtagtcagctataacatttaggtctgtataagtacactctatgattttcacaccatgatgaaattgtgtaatgacttacttctcagaacaaatgtttgtctttaagtgatgcatgactcttttttaaaatctaattctcattaggattttttgataaaaataaaagacacagcatctcctatctcctcttgctttatttactgggaaaaaatgataaacttatgattactcaaggcctagttatataagcttactgatcatctgtctctctctccccactaactttattgtctaagaaaatgataatcttgtgggtggaaaggaaacctggagactagtcaatctaatcagtagtagcttctggttgaaagatatcctattgcctaagagacatttaacatctttggttaaatacattttataggaaaaataaatgaaaatataaaatgaagtttggaatgctgtggcttggaaatctatatatgttatgtcttcccacttgcagataataaatgaggaatatttgctaacctttggtcatcaacttgacttaaaactgaaaatttggctgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaacctgaaaattttccaaactatgtagtttcatgttcttgtcaccaaccaacactcatgaaagatctctgtccagaagcagagggcggagtggatggtttaggagtaggatatgtttcctgtttattaactgagtgaactcgggtgagtttcctcttcatctctaagttcctcatctgcaaaagagggataaaaatactttacttgtagtattattatgaaaagtaaaattgtaaaaatagagccttgcacatattaagcactcaaaaaagggcaactatgtagcaaattctataccatgaggtggaaattatgtaggagggcgagagtttgtaatggagtcaggcagttaagaacatctacctcaagaaacccaattagtacatgttccattcattcatggattcaagcatttaagccacatggatttcagtggctaatacaatagggatctgggaatataaaaggtatcgtcccttcctccaaggagcctaaattctagtagcgagacatatgtcaaaacgtatatagtacaatttttggtacaataagaggctatactaaattctgtaaaaatgaatagagaagaagtgcagggatagcttgatcaaagaggcaccattttagataagctaaagatgactaagttccataaatgtattcactagctgtgtgactttggacaaattactgctctgagcctcagtttcctcatttataatatccacaggatggagctgtttcagagataaatccagtaatgtatataaaactcctggcttatcctggaccacagtaagcactaagtaaaagttaaataaatatcaaaattaggaagttgtgtagtccattacttatttaataaatgaagaacggaaggagaagaggaaagaaagaagcaagaaaggtggcaggcacccatagaaaagagcatgtctggctgggcgccttggctcacacctgtaatgccagcactttgggagaccaaagcaagcagatcacttgaggtcaggagtttgagaccagcctggccaacatggtgaaaccccatctctactaaaaatacaaaaaaaaaaaaaaaaaaaaaaattagccgggtgtggtgttgcatgcctgtagtcccagctactcaggaggctgaggcaggagaatcacttgaacctgggaggcggaggttgcagtgagccgagatcgcgccactgcactccagcctgtactccagggcgagagggtgagacttggcaaaaaaaaaaaaaaaaaaaaaaggagaagaaaagaaaagagaaaaaaagaaaagagcatgtccaattgtggaactttgaatgattgcaaaaatactggactgtgtagggctggaggtagaaacattgaactggggagcaggactaaagccagatcacaaaactccatatctgccctgccaactacggggcagagaaataacaaaatttgctttgttaatttcaaaagagttccctggcttcatggcagatgatcaaagaaaataacactaaaggcagggaaatctagtgagtagattcctaggtagtttgaagagatgagcctgtttgctagaacgaagacaacagtggttaaggttggggcgaggggtagtcctgagagtcacataggagctggaaatgatgtggggagtgagaaaagggcacaggtttaggacagttctgcctctgggtttctgccttgggttactgcatggatggtaattttgcctagatagaacatcctgaatacccttgtaacctatcttgctgttgtatacaaagataaaagttaacactacaaactactctatatctaagaaaaggagaccatttcttcagctcatgacttcactgccacagaacacaatggcaagaatccactgatgtaattgcctagggtcctcatttcagaagtaattaataattacaagaagtgtcagtcaccttaaatgcttactttcaaagatttcctgatgcccagatgtgattggaattgttaacaaacataatataagaaccccagggatgtgactcagtatcatgttgtttatttgttcagagttttacagaaaaatttgttaaaactattgaatacagtcttgactgaaggagtctatttatatacatggttaaagaaagcagcaaataaaatccccacagggcctcagtgttggggacaggactggcaagactataaatcagaatcttcctaatgttcacgattggaatgagataatgcatgagccagaaaagcaaaaaaaggatttatgatgattctaaattactccctaacctggcttatgtgtgtctcgagtcttagaatgagaagaaaattgaaaatagtccagcctttcttcaataagtccattgtggcacaacaaataccagttaataaaaacttattgtaaaaactattatttaatgtatttgaagaaccttaagtatgaaataataatattcaaaaggtagacattcaagtttaagagactctgaatgatctttgttgcggggggtcactacaaaggattgttgggtcttgatctgacatgttattttactttcctttttttttttttttttaactttttgactctaagtttcttcttcagattgttgagaaaggccccaagggtctttttgtaaaaaatatattacactgttgagctgcagaatttatgttgtggttatgatttaacatatgatctcatttaggtgtttattaaaactaatacaaaatgagcaaacacattacaatctcattatttgcttattaatagtcaattccctggtttatgtgctaaactaggattataatctaaattgttattttcaatctttgagtagtactagtgattgaaggtctactgcttacatattgctcagtcctggactggtaaataaaatgaacacagtctctgttttgtgaagcacacagcctgctgagggaggaaaccatatacacaaatcaatatatatttaaaattacaatgagagcaatgaaagaaaagaattgggtggcatgagagaaaataaggggatcttatttatatctgcccatgatggaaagttattctgagaaagcaatacaagataaagtctgaaaattgagtaagagttagccaagaaaacacttgaaggagagttttctagaagagagaaaaacatcacgaaggctgtgggaatgcagggagtttttacagttatgttaaggatgttgaattcctttctatgtgaaaggggaagttgttgaatgattttaaagtaaacacatactatgatttagtttacaagttttataattctcaactgtaaattgtttccaaaacatttctcagcagagttaaatgatattgcaaagggccttaggcgactgtgaagttgaattgtgtttctttaaaaatatgaggtggctcacgcctgtaatcctagcactttgggaggccgaggcgcgtggatcacctaaggtcaggagctcgagactagactggccaacatggtgaaacttcgtctctactaaacatgcaaaaattagccgggcatggtggcacacgcctgtaatcccagctacttgggaggctgaggcaggagaatcacttgaacccagcagatggaggctgcagtcagccaagatcacaccaatgccctgcaccctgggctacagagtgagactccgtctcaaaaatatataaataaaaaaaaaaaaaaaaaaaaaaactttatacatttcttttaccacgttacaaaacacttgatattatcctattgaccatcagtgttatatgtgcatcctactaaatttacattttggggcgagcagtatacatagtatataaatactcttacaaatcaatatggaaaacaacctaatgaaaaaaacaggaaaaaatatgaaatggtaaaaaaaaaaaaaaacacccccaaaatgttcagctcaatattaactggggaaaacgtaaaccaaagtaacagtgagatactatattttatccaaccagctggtaaaatttatatatttggtgatagcaaaggttggcaaacgttttgagccacattcacaatcatccactgctggtaatgtgcaaatggtacaactagagatgtttggcagcttttattaaaattaaaaatgtacattacttatgacccacaaattccatctctaggcataaactgtagggttaaactcaaaacgcttacacagacagccatgtataattgtgtccgaaattggtgggttgttggtctgattgactcttcaagaatgaagccacagaccctcgcagtgagtgttacagttcttaaagatggggtgtccgcagtctgttctttctgatgttcggacgtgttcagagtttcttctttctggtgggttcgtggtcttactggcttcaagagtgaagccgcagacctttgcagtgagtgttacaactcttaagatggcacgtctggccgcgtctggagagttgtttattcctcctggagggttcgtggtcttgttggtctcaggagtgaagctgcagaccttcatggtgagtgctacagctcataaagtcagtgtggacccaaacagtgggcaacagcaagagttatttcaacaagcaaaagcacaaagcctccacagtgtacaacatgacctcagcacgttgccactgctggctccagcagcctgcttttattcccttatctgccccccgcccccccaccccccccccccgcccacccccccccccccgcccacccacccacatcctgctgattggtccattttacagcgagccaattggtctgttttacagagagctgattggtccattttgacagagcactgattggtgcattttcaaacctcgagctagacacagagtgctgattggtgtatttacaatcccttagccataaagattctccaagtcccactagattagctagatacagagtgcctattgttgcatccacaaaccttgagctagacacagggtgctgattgatgtgtttacaaaccttaagctagacacagagtgctggttggtgtatttacaatcccttagctagacataaatattcttcaagtccccaccagattagctagatacagagtgcccattgggcatccacaaaccttgagctagacacagggtgctgattggtgcatccacaatcccttagctagacataatccgtactagactcaggagcccagctagcttcagctagtggatcccacgcaggggccgcaggtggagctgcccgccagtcccgcgcagtgcgctggcactcctcagcccttgggcggttgatgggacccggcgccgcggagcagggggtggtgctcatcctggaagctggggctgctcaggagccctgggggattgcggggggctcaggcatggcgggctgcaggttccgagccctgtcctgaggggaggcagctgaggcctggcgagaattccagagcagcactggtgtgctggcactgctgggggctcctgcgtaccctccacagctgctggcccgggtgctaagcccctcaatgccgtgggcagcggcgcccaccggccgctctgagttttgggccggcaagcccacgcccacccagaactcacgcagccccgcaagcgcccgtgcagcctcggttcccacacacatctgtccctccacacctccccgcaggctgagggagccgactccattctcggccagcccatagaggggctcccacaatgcaacggtgggctgaagggctcctcaagcgtggccagagtgggtgcccaggcccaggaggcgcccagagcgagcgagggctgcgagggctgccagcacactgtcacctctcataatgatattaattgcaacatcacaatagcaaaaatgtacataaaacaaaggttaaactgtaagacaatggttaaggcatggcacatctatattctgaaatacttggcagtagttataaattgtgagttagatctatattactaacatggctagactgtgcaagggagtgaataaagcaagttgctaaagaatgcagataatacagttccagttatgttaaaacagtcacatacactaaaactgtatgtatttcttacagttgctcgtatttataaaagcaaagaaaaagttcaagtagagaactttcattgatatttaatgttttaattatctataaagtgacaaatcatgttttactgttcttattcctggtcctaataaaataatccagctaagtccatgcaaatttaaaacaacctcttattctgtttcattgaatgctatgaaataaggatttacctttactttgagttttaagagaatttagtttggttttgtggatatttgctgacttttcagctattgaaatatttttaaatacaaattcacaaatgagtatttgaaaaattggaggctttcattaaaatgttcaggttaaatccaggttatcctgacatctaattttatttcaagtcttattaatcaaatttttctttaaaattttttggtcaaaattatttaagtgattttactgatactagtacttgtttccactaagcctcctcttaccagattccccttaccagctccttgagggcaggcacatcaacttgctaaatcaatgccagtatagcagtcaacctccttttaggcaaatgctctataattcaacacctttgacttagcagcttctctgaattttcatcatgcaggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggtgaggccaaggagatgggatatgacttgactttctggtattttatggcagaccatggctttaaccaaatggtgtattagcaggaagagctgtactgtgtaaactctgctgctgtggtgcaaagggtcccccttgtgggcatgaaaagtatcttgtttcacatttcagaattcctcaaatcacgagagaaatattaaagagggataaaggaggaatgaaagggatgacatttttatatgctatactgggaactggagtgcatctcaagttctttacgttacacacagaaaatgttgaaatttttatgctatcaaatttgataatgatgttaaattttatgttattcaaatttgctagaaaagttattgtacttatatttacactgggaaaaatgacctagtctcaagtaatcttcctcaacgattctgtagctaaagtcattccacatatcaaatttaaattactctttttttttcacaacttgcttacctaaaacccagaggaaatttgcatgtatgttatccaatgaacagttttgtattgtctgctttctgttctgaaaattttcagaattattgaggcattccccaattcattaatggctagcaatttacctacaattgcattgatatcactgagaaaaccaattacaatctagatctctatcatatttctttctcaatagattaagtgatgcctctggaaaatatatcagttgttgttgaggatttctgagaaaagtaaatgagaaataagaaaagaagggggtgtctatttacacttaggattctctttcaatgtttcagttttgaaatttaatggtctttgatttgtggcagtgtttgctgcaaggtcgataaaaaaaatgtttatttccttattcactgacctttcaaggagaacatacagtaaaaaaattccccaggtgtcaatatcaggaaagtggtattttccctgaacaacttctatcatgcatgctttccaccctagtttaaaaaatgcatccaaataaatcttgatgtgactcaactgattaaatgcatgaaataaatcttgtaatatataatatttcccaattatgtaagctgctagaaataaatatgagatctgcaaac

SEQ ID NO: 220 - DNA, 541418 bp, Homo sapiens
gatactttagagcggagggatgtattgaaacagactactgctacttacagcaccgtatagcagccctgctcctacattttgctgccttactctgccccgaatgcactggagtggggatggtccatcggcaactataaactgattctcatcaggaaactgcacattatctccccatcacttcaaaggtctcgtcaggcagaggtgacgccaggagatgatttaaaggtgaaaatgacaaggtttccacccctcaaaccttggctccttttctgacaatacagtctgaatgaacccgatgtctttttttttactgtggaaataggatcggaagagagtaacatttttttttttttaatcctgataaagaagattgttgggaagctctttgaaaaaaaattttaaattgtggcacagatggattttaaaaagtgttagatctttccaatgaacactaatagagtactctgctcttggctggatttttcaggtaagaagcatctttaagggtttaagattcagaaagcagatctgaaacatatccaggcatatctagagaactgtgcaaggctgaatgctttatttggggaagacgcttaataacattgagacaaccccttggtaaaggagcaagcagtgagagtgacatgcaggaggcttggaagtaatgctgagaatttaaaaaagttaaattaaaaaaatatatattgcaagcataaaatcacagtaatccttttgagtggtaggatctatatgggtgaagaaatgagcaagagaaagcagtcattgaaaaactattaagttttggttgtggcaggatttttttttcaagtttggatgaatttccagtacattttaactgcaattcacaagcagtaaatacatccacagtcacctctgttttgtctttctgtaatttgcagggtattctgaaaaagtccccaaatacattcattttaggtttcacaggaggggtgttgctgtttatttccactgaagagaatgcatgtatgttatcccaatagttctgaaaacaataaggcaaagtatgttgtatacaaaagtaaacagtgggcagtgaaactaattagaaagtgaatgctccatctgaatcacagacttaggcatgaatagcaccaagctgttgaaaataatgttttcctgctttgcacttaattatagttgtcaccatttgtctattatagtcctaaaatccttccaagactgcatctctctgctaaaatccacaaattagcgtgcattatgtgcatacatatgatgtatatttttgttttctgaacatcagtttttaataaagaaccaattttcatgaataaagaagccaggctgggaggttactagcacgttttcaacgtatagttgagatttttgaagggtatgatttgacagtgaaaaggaaaagaaagaaagaaatcttccaaagccctctctgcctaacagaaaagcatacagttaactggattcttgtgtagaaaatgcttccctatcactggctgagtaaggacggtgcttcaagtttgattaatttggcaatatgaaatgcagcataaggtgttgtttgagaaattggacaatatatagcgcagttgagcctttgtagttcctaagatcctcataggtgcagataagactgtcaaagtttcagcacccgagaaaaggtacatattcatccataaatacatatgccacctgtatatgcatattcatcaatgctatacaacaaaagctacaatggaatcttaggaggctaagcaatattgcaaattatggcttgctctaggatagaagcataggtgttgcatctgaaactcattctggctaaacacaatcccttctgattcttaggtccagtcaaaaggatcagttctatcaggagattacaacatgcctctgagaaatgattacttagtttagaagacagcattgcaattaaaaattcatgactgtagaattaaaaaaaaaaaaagaacccactctttccttccaggcttatgtcagacttgcaatgaagttagaatgaacaggaggagtctgcagcttttcagtgcctgggataactatagtttaaagatcattgtgtaaaataggatttttagtcagcatgcattgttttaaaccgactaactgatagcctaaaactttatttttgcattttgccaatccttggagttttgttttgcagaattaagaaaaaaatgaatgtatgatcatctgaaaagggctttctctcaatcccacttcatggcatgacctctgctggatcattagttctagccagagaagtagcaaaggaacatgacgtctgagacctcccttccctcatcagtggggctgactgagctgggggcttgaagccggaggtaacctttcctgtcgaatgttctctttagagaatggcaatggtctctgcgatgtcctgggtcctgtatttgtggataagtgcttgtgcaatgctactctgccatggatcccttcagcacactttccagcagcatcacctgcacagaccaggtaagtcaggagctggctccactgcagcctcctccagtcttaccactatttccttaacagatggttgaatgcaagtgacataaagtgctatagtgtgggcagcttgcctttgaattccaagacatattgttggctggatgctttgggggaaggggagtgtgccaaaatgtcttggaggtatttctattaatttctcagaaaaggtgtgtttttctaagtgtcaccccacctgcttctacacaccttgaaaagtagaagtcatctgtttttggatgctttggccaatagcagaatattctgcaaaagttggaataactttcaatacttgaggattttacctactataatcttggtctgtatgtggctaagaattttgtgggggcatagtccccaaactaactttggaagcaagttgtcaatgaaaaagaaattaaaaagtaacttactatttcttgcctggtttaatgtgccttctttcctttctcccttccttcactttctgttcttctggtatgctcagtggcatttttccctctcttttggcagtttcagggacgaagtccctcccacctgatttttgttttgttttgttttgtttttcctatattgaatttttagttccggacgcattttgctttcttcctcttaatgttcaaagtatatttctcacccttccacggcctcgctcttcattctggattttgctctccttctttgcctctccagctttctcattacagtccctcccagctcgattgtccttaccttccccggttcttggaaaaatttccttccattttctgttcagtatcagccttcgcatccttctactactcaccccgccttcaccctccaccccacctccctccctcccctcccttcctctctcgcgacggtcaagttcgggctctggggaccagttgcgcgcccaagtttctgatgctcagttctgaagtgctcccagccctccacccgcctctccaaatcccatcaatggcctcctccccccatccgtcgagcttcctcctgctgcgtagtccagcgtctacgccctcgcctttccctggctcctcagtcggcctggacaccgatactaggctcttctgtacagccctccagcaataccttccggggccccgcttgctgcctcctggggctcagcttccctgctgggggcaggcatgtcagagcgcggatgcagcccagggtcctcccgcgcgcctgcaccaggctgcagcgagcgcgcaagcctgctgggtgctggagctcgggccgccccgggagaaggggtggggctggcttgtgctaggggctgaggctgggggctgtttctgggccctgccaccctgtttcccccagccctggtctgacagggaaggcgagggggcgctggtgcccctgcaggtgggcagggaaaccgccctcttcaggacgcgcttgtatttctgcatcctgtgtcctgagcctggcgcgggaaccgccactcaaaccctcagtgcagccgagatggagggaaaacaaaagtgaatttgagattcccactttacctccaatcacttaatcacaatttgttctggcacaaatgtctttcacttgttacatggtcataaataataaacagtgcgggacatctgcattcgttgtgatgatcaagaataagaattcataataaaaacaactactacgtgtatgttttaggcagggctctgaggattagttcacactgttcagtttaatccttatgcaagtgggtgtaatttctcccctttcgcccaggaaacagaagctctgaaaggttaggtggcttgtctgaggccacacagggaatagctgccattggaggtcaaatcagcacgattcaccgccagagcctgtgtcctcaggaggcgaaaatgcctctcggtgcaccgagtgaccatgccaaatagcttctttgaggaagtgtgagccccttcatataatttttgaaaactttcattatgtcaatacttggtccaatctcaactgcacacccattctgagaggtggccatggcagaactagtgagtggcacgtggttgagggggaaaggcagggctcggggctggccacctgagtctctgtcacttaaggttagtgacataaccttgggcaactgacttttctgctctcattccccatttatagatatggtggttgggggcggggagaggtggggtgtaaatataataaaaataacttcgaataagtcttttgtaagctgtaaagttcttcacaaatattgggaattactgatgtccccccttaatagactgtaaacccacaagccagggatgtttgatgaataaagttttgctgttcacacagctaataatccacatagccaaggcaacaactcttttttttctcttgctattgttttgttaaccatgtggtacatggctagaatatactaccaatgctatgtgtcttattttactctgtgcgtataatcatgaaatagatacagtaccgtttgtaacaagctttcacatagttgtctctcttaatcagtgaatatatggagtttttcattgggggttatgtataataagtaaacttatgtctttatagggcttattgttaaaataccgtagtttaaaactgagaatcacatattaggttctggctgaaattaaactcaatatttgttttctccattttcttccttagaatttgtgtattatcaaccaatgcgtggttgatctgtgcgtcaaataccccaagaaactgcagcactgaaaccaattttgaccccaagtgctaatacatctgagacccatttcagctttattgttgaaatgaagaaactataaatatcccttcctagatgcagaatgattaaaatgatattaaacttaacatccaatagttctatataatacgtttattcaactttctttggtttttgacaatagctgcaaagattaaagtgatagatcttggtcatagccatattctagattattccagtcagactctttaatacaatcttttgattttaagaataaaaatatgcttttattttggatgagagttgtgacgttttcccttgtaggtcttaaatctccagggacactaatgaaatgtgtatgaaaacaagatagaaatcagggccagttatctgtgacaatccacccctaaatgaacaaataaataaataaattgctggataaatgagcaaaaaggaaaaacataatctcattttctcaaatcggttaaaacaagtgacatgatgagaaaaaaatgagacacccgcagaccctgagctctgccacatttgcctaagcttgaaaaatcacctctttcataaagcaagagcaggcagactccgcgtgcataccaagtatctgggaaatgtggaaaatgacaaatctttcactcagagccttgaatggaaggagagtgaaagctttacagctgcttcctcacctgcttaggaatggctccccccaatcccctccctctgttccccagcctcttacgggcactttggctgttccttgcatggtaatattgatggtattcagacagcaaacagccaatttcagtctctcaagaaataatccactacattgacaggtgagtggaatttgacgtgatgttcccctcgttcagattgcctcacctggatggcaccagccagccagggtcctttaggggaaatggttagagacttgggccaatttctgctgtcataacatgaaatcgagaccatgtttttgtgaggccgtgaatttgtgatctgtcttctcaatgcagtgggtttgtacacaaacagaatgagaatatgttaactagaaaactgactcattttaatgtattcgcctgcagtccctaactacttcctatttttcatatttatagtattaggaatgcaccatttattttcagttactcactagttaaggaagattaaaacagtcaatcaaatgaaagtgaattttaaaattacactaatgagtaaaatgtgctgtagattaacagatttgtaatttcaataatttaatatttggctggatcaagtttttatttggggaatgatgtaggaaattaccctaaaaacttgaagaatacttgagcttcttttttatttttcattataaagctatagacaggacatttagttgtaaaaagacacactaaaaaatgaaaactcaaaagtggtgttcaattgtttcaggtaattataaaatagacacctcaactctttataatcaccaggtttttttgtgtaacaggtaaaaaaagattgaacggtttttgctaatcataattttctgttttaggatgagtttttccccttatggatatatgaattaggacagcaattttgatagttacttaattttgaatgtgtgtgtgtggggggtggtgggggggtgggtgtccttgaaacttagtaaaatataaatcatctcaaaattatttagcaagagaagatccttgggattcttcagtaattttaaattatatagataaattacatgagacaagaagttttaagtgcctaatgaatcatttattcctgagtcactgctattttatcgacaggggtgtacggaaatgatatataaaaagattactctgaatagagttgtctgtgtaatttatacttgacctgatttaaagctatattaagcaaactatgtgtgttagatatattcatttttgccttgattattacatactgaacatcaccttccattttaaagtaggatatttttgttaaaatattaaaaagcatttttgtatgccttatacttatttttaccttactattcaatattactttattgaaagctgctcagagaatatgcagtagaataccagagtacattacaataaagggttgttttataactgtaatataaaagaaatagtgggtacaactatggtcgcatattggctctttaagaatgcgtaccagtgctaggctgctaaatatagcgaattggcctaaggattggagcagacaggttgttattcggtgcaagctggtgcttagtgataatccatcgatcatctgattgatcctattgacctcatcgcagagtcagggtgcagctattgatatttgatcagaccctataatatcaaagccaaatacagatgcaaataaatatttcctgctgatcttatgaacttataagaaaattattacaatgctataaaaactcttacttacgtaagctcaaacctatggtttcaactcctagttagggaaaatagatgttataccacactgcaaacaaaaatatttagaaatggcaaaaatgaagtttagcctttaattgttaatttcttaaagtttacttaagaagacaatttgaactcttttaaacattctttcaattttaaactttctgcgaaagtatcaaagcttaactggataaatcggcatgccatttttgataacaatttagtaacatctcccaagatgtaaaatgtgcaaatcctgacacttccatttccaggtgcttatactaagaaaattattagacaaatgtgaaaagatgtatgttaagctatagttattgcaacaatggttttaatggcaaaaaattgaagaggagtttcatctccgtcaaaaggggattggtaaaataaatcatagcacatccacacaatgggatttgatgtagacattaaaagggatgagaatatgtctatctacccacgaggaaaaatgcccatgttacattgctgagtggagaaaacaaggaacagaatactctgcttcaaaataattttggagaaaagaatcatatttgcacatacataaaaatgtcaaaaaggatataaacatcctttctacagtggtagttaaatctggtgagaggactagaatgacttgaacttttaacttcctataatttttattttttggattcatttttggaatgaacatatattgctttttatcaaaaagcttaaaatattagtgagagagtttcaatggtaaaattagaaagataccaaaccacgtttccagtttaagaaaaaagaagggagaataagtaggaaaatatcatgaggcccttttccttttaagggtcttaatccagtaaaatgtctaggccagcatttcagaattatacttcatgaaacactgtcttctgaagatactccttggacaaaagtgtccactgtttgttatgttctcctcctggagatttgcagtgcttgtaagtatatgaaagttctggaaagatttgcgtgtaagaaatctgattttgtttaactaaaattttccagacactttttttttcgacagcatctaccatacctattcagattacatgcattgagaagcatgggccaagataattctggaatcctctgttcatccttttatctctcacttctactgagttgacacatactaggttctcagaaaatacttgtttaattactaaggaaacgaggaatgaagattttggtggaatcttaaactgttccttagttgttactacttgtgtgtgagtgtgtgtgtacatatggatgtatgtgcatttttgtgtgtgtgtttataatttcgagatttctcaaatggagagtgtcataaacattattttgtcagtataacatacatgtattatgtgtgtatctttatgtagatatttgactctattcaattttgacagctactccattcaaaataattcaaagactatacttacaagtgtagtaaaaaattaaatccctaaggttttcagtcacaggtttggggatttttctcctctataagtttagaaaagactataggagttgtcttgagggactgaagaggcttcacttggcaaatagggaaaggacttttactttccaaatcttttgatatcaagagaaaaagtcactttgcctttgtagcagagagaaaataacaccagacaagcactttttcctttctttgggaataaagagaagatgaattttgtttaaaatttgtataacctaattgaattccccaaagataataccctcaaagcacttagggaactctgttggcccattatttctttctcttttcccaacttcatataataaagttccaaaaaagaaaagaaaaatgatattatcacagggtttctccaagaaaatggataggaatgctgagggatctgcctattcattaagcagatctttctttaacgcagggaaggagtcaaaccaagttgttctctgagtctgcaagggaggaagacctctcacatccttaggtgtggcattgttctactgatgtaattactggcatttacctttactatgcagttactagaccttcttttctaggtgtgctttcatatcacacaagaataaatccaagctgaatctgtgtacattcagaggacttttcttattttccacttttgtggatgaagaatggaccaattgattcacatactttcaagtgaatacagaatgtcagctcctagatttagataagctaatacacaggcagggggtaaagcacctcagtgttcctgaaattaacagtatactgcattaggatcagcaggccagcaggtcttacttctcattgaattaatattgggtatgtattcaataattatttattgatcatcctagctttagccgagtgagaactttacattctttaaaattcaaaaagtggtagaaaaacatcacattaagcctttttaaaaaatatcaaatggtaatgaggaaagagcaccagagtaggagtcagaggctggagctttcaagatctcctttaagttgtcaaattgcaaagctccagatgagagcgtgggaaggaattcaacaattttcatgttgtacctggtagctccaagagggggatccatgtgttccataaacagtgaagtatattctgccaaataagttttaaactacccaaggaactggtttattaactttatctatttgacatagcaggattcaaaattaccttttcttatgtaaaaaagcattctgctaaaactatttgaaaactttgtggatgatttcataggtaggcaaagcaaacaccatcatggaccaggcaggtgacaaaatgattgttcagatattaggaaatgctgaatattgcaaggcaagccagaaatctaaaaattgatgtgtaattttcttaccttggaaatgtcaggtgggccaaataaatcaagactgatggctctatcctacctgcaggctgtcagtgcataacctcagacaagactacctccaactctaacattttatgatttctaatgattttatcaaatatctttatgcaagcagagtagagagagaagcgagggaagtggaatcaaaaggggatgttctgtgcacatgtgttttgacctactttaaaaatatgcccatggtgtagtcctgtactgagttatacccagcagactaaaacattgtgtctgtaagctaaatggtattactggggctctggtaaacagctttgatataatgaagacaatagttgattcaatagcctcatttgaatctcagctaaaaatcaattaattttctttctttcttttttctttccttttttttttttgagacgtagttttgctcttgttgcctaggctggagtgcaatggcatgctctcggctcactgcaacctctgcctcccaggttcaagcgattctcctgccttagcctcctgagtagctgggactacaggcacatgccaccatgcccagctaatttttatatttttagaagagacgagggtttcaccatgttggccaggctggtctcaaacctctgacctcaggtgatccgcccacttaggcctcccaacgtgctgggattataggcgtgagccaccgtgcccagcctaattttcttcttgattatggttgggaaaaaacagtaatcagcaaatctaataaaacagaagcatcaagcagcatagagatgcatatgtaaaactcttaatttaatactttatgaaagttctccaaatctagtctgcagcccactagtgagttataaatttatcttgaaacccaagattctcttttgggaaaatgatttatgatatcatatatattcattttgtctatgaataaaggctacttattagtaaaacaactgagttatcattttgctataaattacatgttaactagtgtttactgaacttccttaattcagtattctttaactggctgtcagctcttggaaacattgcaaagtttctgtatgcaaagaattagaattcatgcaatgtggagaaggataatttgttatcagtgtgtcatgagtgttgtcttgagttattagtgattttcaattgctgtggtccttgttttttaattataaattagtagtggtttagtttcatcattatcaattaagtttgctgtggacgattgggttaaccctgtagtctgtaatgatggatatttacatattttggattttaaatttgctgaagactagactttaagacattgcttaattgtggttcagaaaatattttatctatattcctattgctaaaacatgtatagtcatgtgctgcataacgatgaatggcttataccacagtggtcccataagattataataccatatttttaccgtaccttttctaggtttagttaggctttttaaacttttgctttaggttcagaggtacatatgcaggtttgtcatataggtaaacttgtgtcatgggggtttgttgtatagattatttcatcacttaggtactagagttaggtttaaatacacaaatacttatcgttgtgctacaatttcctacaacattctgtaccctgatgtgctatacagcttgtagcttaggagcaataatctatatcatatagcctaggtgggtagtagtctatctcatctaggtctgtgtaagtacactctgatgttcacacaatgacaaaatcacctaatgatgtatttctcagaacatatccctgttgttaagcgatacatgactgtatttgtaattatcttaaaatttgcttgtatggtgatgtatcgtgacattgttggtgacattcactgcctgcaaacctctgcaacatattctcatgacccataatatttatcttattttttggttcatagggcatcattttataatataagagcatgttaataggtctttcttattgtatgaaaaataatttgtgattcatacaaattttcttctaagtatttattacttaagcacttttccactggaaagtgaagacaggaattagatatttcaactactgagtgtgctgtggtcaaggaaagtttgaacaccactgttctatagagaaatggtaactagaggtcagccctttataaaaattgcgactttaaaaatatgtggcatagcaaaaagtataaataaatcaataaatcccctattgtgaaataaaatgataagatataagacatgagtacatgttacttggaagcttcccggatgggggtcttattaaaatgaattggttttgtagctttttacatctctttatctgatgaacatgcaagatgccacctactggacaggtgcttgagaatctaggtcactgggtgaacatttgtagggcaacacttttgacagttgcttgcaggattgtttagaagtaagagcaaatttatggcgtgcatgttgccaatctccagacttctatctatcaccagcttaggttaatcagtcacagcagttgctcacacagagcctagatgtgattttagaatctttttcaatctttctccaggcactccctgtcaaatgattgacactggcatgcaagttgagagtcattgaccatcccttatgtgggttaatttgctaaccatcttcagagtatctcttctatccaaaaaatgtgtgccatgaagtttttttcattaaaaaagaagaaaatgacctaagtttaattaaatcaaattgaaatttaaagagccacatgggtccaatagctactgtttaagatagtgcagctttagacagttctgtcaacttctgagagttgaaaaacttactttgtattacctccagaaagttttgagtcctcgcctgattcttctctaactctgtgtctaagatgcaaagctgcttgtgttatgggtcataactgaatagggtactatgtaatcataaagcaggaagcaattcattctgagcagagaagatttgggaagccctcatgaaggaggtgattttgtgttggactttgaaggttgggtaggaagtcagctagaagaacggaagggtggtttatttaacacaaaggaacagaacaagtaaagacttagagacaggtaagtgtaaaaggatggggtagcagaccttgatggctagaggccctgcactagttagagaaacttttgtatcattccaattaaagggaaaacaagattttatttcttaattacttagttttacaatctcaaggctgccttatcagtgtacattgatgatcacagatggagatggatggaaagagccccagtgtcacaatgagagtctctatggaacacaagtcagccaattgtcaaagaagtggcaaccatattctggccagactctctgagccctgtggggcctttcacacctttgaattattgttatctttgtgcaatgaaaggcaagatgtgtcataactgttgatttcaaacatctggttattgtattaaaggaagctgcataactctaactcaaacctaagatagtaattatttttaacttacaacaaacttaatatttatatccaacaaatggtttattgcacctcctaggggcggaggactacagttacctagtagtaatagaaatgacactttactatagtccctggtataactctgatttccctaccacatcacaagctatgtgagggtaaggaacccagcagtctgacaaatgcctgaaacggtgtggcacacagtgagggccaaataaatacttgctaaatgaaggaacgatcttaagcatttgatatttcagttaaacctcacaatatcctcatgaggtagagcatcttcccatttttctagtaacaaaaatgtaaaagaatatgttaatggatttgtttaaggtcacctagcttgggagggcaagttgggagttttgccagcttctgaataatggctcggtttactgagtgcttgctgtatacaagccttaacatgggatgtttcttatgatatgacatttggtctgaaccaaaaccctacgtagatggtactgttattcccatttgtacaaaacattgcaaaatgtgcttaataagtataaacataaaaggaaaacttaggttgtgtaacaattctcagtcaggtttccgttacaaacaagtactacttttaggaatatcagcaatctactcttggtcaattgaaattaaataacaaatttctatgttgaggagcattgttctacattagccaggcatctgtttcttgggcagttagcttgttgtatatcatgtaatagttttgagtactgcagctgaataatgcttgattcttaatttccctatgcaaacaggcctggctgaaagcatggtttttttcctttctggattaacagtgcctaattttcaagcattttttacagagttattgtttcccaataaattcttttagactccatagacccttttgtgccccagtcagggaagcagcagcataggataaatctacatttattagacttgctcttagtgtagattttttggtttacttaaaatgaagttataaatcattcacactggaaaagaatgctctccaactgcaatttaactttttcataagattgtttggcatttatcatgttgagactttataaattatctagaatattgtataatgggttgacctttctggtaagtgatttgatcatttgcagcagtgtctttttgctaaaatatagaatatgctgtctttcaaataaaacttgctagacccatagcctaataacatgttaggtagaaattgcctatataatcagacctgaaatttccctttccaattcttgtcatcatcaaaaacaaacaacaacaacaacaacaacgaaaacaacacccctgtcttccaaagatagcccgccggccagtgatggcaaattcctgacacacagcccattcttcctatgattttgctctagcagacattgctgatcaattactatatgctttgtgtttgaacccagattcaacctctgaatccttccaagcacagtatagttctccagtcattgagtaattaaatgagacaggaataaattcagaaacaaccagaataactcctcttagaagaatcatcatccagcactactatatgtcacatactgggctaagtgccctacatggacttacttgttttgttttgagatgaaacatgttgtctgttcctgggataggctgttcttttatgcaattcagttgtcccatcaaaatgggccacgtagcatctacttacatctttggaaattgggcaaagagttgatttgcttgcaggtcttttacctgccttcaccctctttgctaccagtgactctgggtctgaggagtctgcagggacaggggaaacttggtatactaggccaaccgggagtttacatcccatctctatcattattacacttatttgctccaggcgtgggcaagtcagtgtaactttctctgcctcacccatagagtgggggtttgtaaaacccctaccttgccagcttaagtaagacatagcgataatgtgtattctgtaagaaatagagacaatgtttggtctacacttgccatatagtaggtgtttaggacatgttatcttcttatattttatgtaaatatgtgaatgtcagagcaaggatggaacggataaactgcctactactaacctgtatgctgataatattttattatatgaaaagatgcacatagaagttttacaacttggacttatttactcacctattatcatacctgagtcttctgataataaaatccatgtactcatcacagtacatgatatagatttttatggttaatctctactatggaatacataatagttggccacatgttctaagtcaatataaacaggtcaatgcttattgtatccttccttccaaaagtacattgtgtacgtaattacaggtgaaggtggtctagttaagaagtttagtggtgtctgaccgggagcagtggctcacacctgtaatcccagcactttgggaggctgatgagggtggatcacctgaggtcaggagtttgggaccagcctggccaacatggtgaaaccccatctctactaaaaatacaaaaatcagccggacatggtggcatgtgcctgtaaacccagctactcggaaggctgagatgagagaattgcttgaacctgggaggcagaggcttcagtgagccaagatcgtgccactgcactccagcctagtcaacagaacaagaccttgtctcaaaaaaaaaaaaaaaaaaaaaaaaaaaaaagtagtttagtggtgtctggtgtctgtgtggtgtcactaatagggaagtttgattaattaatgaagatacctgaccaataactcattaaagggaaataatccaaaagttagcactggtgttttgtgaccctcagactggattataattgtgctatagttctattaaaagagctactagtcagctgaaatcttacagtgtgtatccacacttcttgggatgcttttttcttttcaataattgtgttgttcttacaataatccatcacccttttatcataggattcagtcactaaaggaagaaatccaggcatattctaataaacacaatggtagctaaatgtccatcccaaggtatcatatgtgtgtttcatctatactgctgtatgtaccctgtattttctactctgaatacaaaatgacatctatgtgtattaagaattacataactaacaaggtgtgtactattttgagctctagcaagaaagaaaagaagaaggaaaaaaagaagttatcagtagtcagtatcttatgatttaagactccagggaatgtgagctagtgtgagagagtagcctatatagttaaaaccatggtttaaagacattataagatgatggtaaatttgcaattagtgtttcagggtctcctaagaatttgtacatgacaggcattagctctctaccgaagagggcaaaaaccatatagaagccttaccaagtgctttgatcaaactttattatctcttttttactgtcctcattaacatacttcaaaaacgctgttaagtatttctggcaagcagagcatcagagtaattttacagtagtgtaaaggatttattaattataatcttttcattagtctatttatattcaattgtgacattaataggttgccaaaacaaactagatttaattgtatttaattaaattgttgaaagtcactaagggtagtttattattattgtaagcagaaaaccctattgatgtacttgtttatgtgaataagatctggtgtaaagttctttctacaggatacggtattattcatcaacaggaaacaatataaaaatgctaagtcaagaaagttgtcatcataatagaacatttggaggcagaagaatcagatggtatttctaaacttatatccagtgttaggtaaatgaagtggggttcctgacaggacagacattcttgtctttctactatggcccctgggtaactccaatagtatctgtccatccttctttcctttcttggaggggctgttggtggggggaagggtctaagacacaggtcaaagtttcagtgaaaagtagtgcttcaaatatcacctgaagaagtaggaatgggttatgccaagagtaagggatggaatttgagtagcgaagaattctaggcaaagaaacttacattgtctttagtcaggaggtagaatgtgagaaaaccagaattagagaaaatcagaagaatacaagggaaaatgcattggtttatcatgaattaatgcatgtaaatgcattgagggtaggagaagacaaagtggaagctggctttgaaaaaaaatagcacttttctccttcaattatgtataagatttatatatatatattatatataatatatatatattatatatatatatataaaattaagatttgtattaagtgtttactatgtgcctggccctgtgctaatcattctatattatttcattaatccttatatttaccactgtgagaaagttactcttgtttttttttttttttttactttgtaccagtgaaggaaatcaggctcagagaggttaaataacttgttcaaagtgcacagttagtaagtggtaaagccagtatttgaactggggtaacctgattccagatcctatgctgttatagactacaacacagaaattttctctgccagtatcattagttttgtttgtgatggacagcgttaagatggaagtaaatgtatgtcaggatatgctaggtgatgctatggtaaccaatcagccccatatctttatgcatacttctttcttgctcacgccactgtctgccaaggttgggtgggggctgtgctctacattgtcttcaatccagaattcagagcagcatctttttgaaacagtgttgttcaccgtggcagaaaaaggagagttttgtaggttcaacatcaaataaatgccttgacttggaagtaacttgcatcacaactcactggccagaccttggcgtatggcttaacccggtagcaaggggccatgaagtacagttctaccatgttcctggaaggcagacagcaagagctatttgttgaacagcattcatgatatggccacaaaataccttagtggttagaaaatgatattttctttgtgacggtactctttcattcttagatatccaagcttagatatcttagcttatttcagtatttgttggatactgaaatatccaatgttgtatcagtttactcagtctataaagaaggcaaaagtgtagatttgagaagggaataatccagtgtgtgaatcaaaaaaataacatgacatcaagcttgttttgttttatttacatatagctgacttttgaatgaattgtcatatggcccagctcctcatttaagtaaaaatgaagcaaacctttgaggctatggaactttctttccttttctccatcaaatctcttcaccatagcaaatacctaagggtcttgcttgcttactctctcctgccctctctccaccttctcatttgtgaatctaatctgtgaactgattcccagttttaagaagaattgccaccttggaataaaaggtcaaagcattcaatactacactgtctggaatgctgctgtttgcttcagatgaaacttttatagggcatattcagtaagtaggtgatatttttatattatcctaagtattttttattctccttatttttacttccagaactgtatcgtttctagtaataaatcagttatggatcaaatgcatccatttgtcatggatgaatgcctatacatgccttgatgatgataggaaacaaaaccttgtaagggtggatgctggctttggaagaaaaaaattaatgaagcttggaaaacagtgatagcaggggacattgcaattttaggtgttaagtgacttattttcaaaccctacgagtatggcaatatttttcctctcccccttcctttaattaaacattcttgtagtgcagagtgaccccagctgaagaaaaattgtgttagggaaagttaggcttcctaagcgctgttatttaataaacagtctttcttattagctaaaatatttgccttgatgggcagggtacattgtgaggccaaaataagagaagaaaaaatgggaaggctagcctggtttaccaacacttctgtgtcacaaacatcaataccaagtgctgctttcttgctgatggttcaggaagatggcatttacatatcaggtttagttttgtgaaacttagctttaatctctcacctcccatcccttaggggcagaataaggctgaggcaattattctgtcaagattttaaaggactctctagaccatctccttaatgcacacacacacacacacacacacacacacacacaattatacattgttaaggtatttaacaatcatatttcggaaataaagagttggaagttgccttagcaaccatgaagactgtgctttcactggacacttcatttgcctcaaaacctcctctgtcaagtggttgttgattcactggttggattttctcccatattgttttggggcatactgaaattggggatgactcctttctctggcctgggcaaaatgtttttaattataaaacagatcttccctagtccccacacctattccatccatacctttcttcattgcagtgaatagcagctccatcttttccattccttactcacatcgaaaacctagaaattgccaactactgtcttcagattttacattccattcttctcagattttacactccattcttctcagattttacattaaatttattggaaaagctatctttctctaacatcatgatatattcagactccaaccacttcccaccacctctattgctgtcaccctgggccgagccacaacttcctctacgtggattataggggaagcctagggtggtctcttgctttcacctttgccacagtctatattctacaatctatatttttcacacagcaggcagatggtgaggttaaaaagttagtcaggtcttgtcagtcatctgttccaaacccacacacagtggttttattatttcagggtaagagtcaaagtccttgcagagggccctaataatatgccctcaacttttacccccattatctccacagcatcttctcctacttcactcttctttgctcactctcctttatccacactgggctccttgctggcccttcaaagataggcacacatctgtattcattggctcttgctctgtttggaatgctcttccccagatgtctacgtgatatacgttctccctgctccaagtatctgctcagatatcacctcctctgtgaggtcttcccttaccactttattgattttaatttcaccctcatctcagaactgcacatctccattctcctggtctatttttgcagtagcatttgctgcctttcaccttactataactcacttacttaccaaacttgtctccctccacaggaatgtaagttccacgaaggcagggattgtcatcagttttgatccctgttatgtcagagggcaaaaagaaggctcttaataaatatttgctgactaaatgaatgaataaataaaagaaaaatgtcaggaccacatgagatagagaccattccttttatttcctatcaaatctaacgtaagtatttacataattcctccacagccttcagctctttgctaaaaatgaaattcctcccttgcttcaggggccctggtcctctgaactgcatgactctttggtcatgggagtgagggcaggggttggcccacagacgaatccttgtgaagatgaggtgactggtccagcagcgggggaatgagagatcttttgctgctaaggctgatattatggccaatggagaaattccatccccaccgagagggtccattttctcccaatcgcctaacagaaatccaaatggcaagttactatgattttcaaacacagaagaattttatagagagacttttcagatttaaatgtccttttcttctgatgtaataataatacccaaaactaatggagcctttatcatgtactgtgccctaccctaagcactgcagacccacacccacatatatacatctgtatatattatttaaccctgacaatgacctgaggaggtaggaacttttattatcccagtttttcagatgaggagatagaaactcaaagtaaatttcccaatgtctcacagctagtaaaggacagagctaggattcaaacccaggcagtctcagtctgcagtctgtgctcctaactactgtcctgtatgttcacttctatgtaccttgtttctgaaaaagagtacacagttacctcaggaggttgtattaattcattcttgcattgctataaagaaatatctgagcctggataatttatataggaaagagttttaattggttcagggttctgcaggctatataggaagcacagtggtttctgcttctggggaggccccaggaagcttccaatcatggcagaaggcaaaggggaagcaggcatttcacatggctggagtaggaggaagagagagaggggggaggtggcacacacttttaaagaatccaaaactgagtatcatgacgatggtaccaagcagggatggtattaaaccacaagaaaccacctgcatgatccaatcacctcccaccaggccccacctgcaacactgggaattgcaattgaatatgagatttacgtgggacttcatggtgggcccttttctgagagtcttctctaagacgtgagaggtttactgccttttgaggtagactatttcaatactggagagttgaaattagacttttctcccaatatttagcagaatcctgaggacactggggctatggaagatgtggattgtttctatttttgtggcaggttgcagagccagccatctctcagtgaagagccatttagttgtaaaggcagttcctatgttattcctggactgtcccttttccaggctaattgtttgtcattggaaatggctcagctgtggcctaagacatgactggcatttgtggaaccccgatatttatttgaacaactcaaggtcacaataggcagctgtatcagcctgccaacttggattgaatctgccatcagtgaaaacccccaggtctatttcacacatgccaccgtgaagtcacatctccttgtctctgttttcacagcttgctatttgatcctaagtgtggactttaaatttgtctctgttattttctatcatgttagatttcaatcttccttccatcttcttggaaactttgaaaatgtcatttctgtcatctaatatattaactagtgttctcagcttaatgtttttgaatgaataaagaaacctacaagttaacacttaataaattaattcccaaacatgaattgaggattccatgttccaggaatgatgatatcatactaacgtttcatcgctttgtgaactgaagagggtttttggcttcttacatatgtaacctaagagatggaaatcccaacaaaaatatttggaaagatagacactctgggatagtttattctacagcagtatagttcaatagaaatatgatggacttggggaggctgaggcgggtggaccacttgaggccaggagttcaagaccagcctggccaacatggtgaaaccccgtctctacaaaaaatacaaaaattagccaggtgtggtggcacatgcctgtaatcccagctacccaggaaggtgaggcaggagaatcgcttgagcctgaaaggtggaggttgcaatgagccaacatcatgccactgcactccagcttgggtgacagagcgagactctgtctcaaaaaacaaacaaaacaaaacaaaacaaaaaagtatatatatatagctgcatctataatttaaaattttctagctagccacatataaagaagttgaacaaaaagatgaaaataatttaaatattatttttaacccaaaatactttattggtcttctatgactgctgtaacaagttaccacaaactgggtggcttaaagcaatagaaattttttctctcatgtttctggagaacagaagtcccagacatgaaatcaaggtgtcagcagggctacgctcctatgggaggctctagagaaaaatcccttctttgcttcttccagattcttgtggatgctgacttgtggattgacttgtggctgccatatcactccaatcttggcctccattgtcatgttacctgttcatcttctgtctgtcaaatctccctcagcctcactcttttttttttaaattttttttttatttttttgagatagggtttcactctgttgcccaggcgggaatgcagtgacacaatcatgtctcactgcaggctgaaactccccaggctcaggtgattctttctccacagcctcctgagaagctgagactacaagctcatgccatcacacctggctgatgtttgtattttttgtagagatggggttttgccatttgcccaggctgttctcgaactcctgagctgaagctatccacttaccttggtttctcaaagtgctgggattagacgcatgagccaccatgactggctagcctcactcttaacagaaaacttgacattggatttaaggccacctagataatcaagggtaagctccttctctcaagattctctatcacattttttttaaccacataaggtaatattcacttgtttaccatataaggtagtactgataagttctagggattaggacatggacacatctttctggaggctatcagcccactacaattatgtctacatgtaatcagtataaagaattattaatgagatagtttacttttttttctgtaacaagtctttgaaatctggtgtgtgtttaacactgacagcacatctcaattcagatgctcaatttttcttgaaaatacttgatctgcttttagattttataaaatgtacagttataaacattgattaacatacttgagttgtttcaaccttatttaaaactgttccagtaagtaaatcaaacatcagttctaaaatttaagttaaataaatcagtaaaaattaaaaattcatttatttagtctcactagccacatttcaagtgaagcctgggacctccttgtacagtggccagtggctactgtcttatattctgccatgatgcaaacgtaaagcccacttcaattatagcatatgaactataatacataaagtagcggatgtactcttacgtaataatgcctagactttaagtaccattaagtttggtaatttattctgaaagtattttgaatgccctcaggagctaagacctgtaaatatggtaataaacaaaatcaacatggtctcaacctcctggggttttctgtctgaatgcacattagtttcgttaccttgcctaagcctcagctgtcagaaattggtatgggacgatagttaagaaaaccactgggcaaatatatctgaaaatgcctgggtaagaagcctgcttagtctgtagagatcctatgatcagaacctcagtagaacctgatgttcaaccttctgtcaagtgtaagctgaattcccatctaaataacttttcttcaggatattaacttgatgttttgtaagatgaagaaattagagaatatacttaaaatatcatgagaataaagataaatggaaataaaatgggtgacattattaataatggcaaacagtaatatcacaacagtaaaacacattataaaaataaaaccagttcatgctttaaaaatttttcttttcaccagcacacacttgatggattttttttttctactttaagttctgagatacctgtgcagaatgtgaaggtttgttacataagtatatatatatgtgctgtggtggtttcctgcacccatcaacccgtcatctacattaggtatttcttctaatgctatccttcccctaaccccccaccagccgacaggccccagtgtgtgatgttcccctcctcgtgtccatgtattctcattgttcaactcccacttatgagtgagaatatgcagtgtttggttttctgttcctgtgttagtttgctgagaatgatggtttccagcttcatccatgtccctgcaaaggacatgaactcatctatttttatggctgcatagtattccatggtgtatatgtaccacattttctttacccagtctatcattggtgggcatttgggttggttccaagtctttgctattgtgaacagtgctgcagtaaacctgtgtgtatgtgtctttatagtagaatgatttataatcctttgggtatatactccacttgatggaattttaagccatctgtctatctctcatacagtatattttgcctgagaggtttcccagaaaagatgctgttggtttgctccttgtagcaatgtacccttaggaatagaaaggatgtcccctttttagtggttttagagagaccacaagtcagcttacttactactttacaagagtttggactcattaccagaaagaattgtaccaacaaaaaagaaatatcatggattttgagatgatcaagcttctaaaatatgttgctactctttggctattatacatcagtttcaagttttgggattgtttcctatgttaacttagcagttcttattcagaatcaattctcagccaatttttagaaaacaaaaatccttatggaagagaagagacctgaaggtttgagtcgataatgttttaatacaaacattattataaaaagataaatattcagtatggattggggcctgaatttatttgtattgagaaattgatgttgaattcatttccttatggggcatctggtgaccaatcttatatcccatctgggttcttatttcattctacaaacatttatgtggggtgctgtgccagcacttacaggtgccaaagaagaagatgaatcaaaggatactttatcacaaagcactcggaaatagtgggcagtgcttataaatgaaaaataatataaggcaagaagtatgtgctgagtaaaggtgtgaggacaaagaaagaataatcattccaatctagaaggactgggaaagacctcgtttgtggaggagatggccgggagaaagatgaaaatcgtcatttccatttgctgaaatgttcctatgtggcaggcttgccataaatcccaaagcctagcagagtggccggtaattaaaaaggatgattaatacatgaaacaagcaagtttaaaaattttgtttaaaaaattttaggcttcattgtgtgaacatccatcccaaaataacccagacatacactatttgtcagaaggttagattggatgacttctatcttctattattttttccgtggcttcattttctgttcaaatctagatattgcttgaatcatatcccattgtgataaaccaagccagaatcattgggacgcgttttttaatagttaatctgtaaattatacggatttgaatcttcttatagtttttccttctctaagctgcagtgtttacctatttacgtattgagtgcactgacatctaagtcttgatatttttatattctctgagatttctttgcacttttagtcttaaatcttaaatatcatgtaggtaccttcatgtttttttcagaccattttggtttttggctgcctgatctttgagaacaaagtaacagcttatctggtctatatgagattcattagttgaagctctcaaaagatttttggttttttcaaacaatgccttaaaatatagacaaacattttctctagatgagcaagtgtactaaagtatggagaagaaatgtgaaagaaatgtactaaaattatcaaatgttggtatatttagtctacccttgttttgatttcatcatttctctcctctttccctctgactctcatgccatataaattctgggcatccagccctcacccagagctcatttcaactcactcacatatccaaaagaaacaccactgtgatggcaaaaattttagaagaaagtaagactttgttgacagactcttgtagaggtagtgcaaaaagaattacatcctagaacacagagtgagaatttgctgaaattctcctgtccatatctcagtctgtgtcatcttccatgttcatccagactccaaaccactcctttcccactgcctggttccacttcccttcccactcctccttctctctggctctgctttttccctcccagactcctgtgtctgtttccttcagtggaacctcaagccgtttcttgtacagaaatcagttcctcttgagcttcaccctcatatcatcctgtccaggaaaacaaaaagatcttccttaggacctacagagccaagaatctgggggaaagtcaaaatgtgtaaactaatgatttgctcttgcgcttttcagttcttttcaattcttttcagtacttgcttcctactcctgttcaacttgtttcttctcgtcacctcccaattcctcattctcttccttcctatgtatgatatcctttcatttcccccaaaattaagtcagaagcaagaacatttatatataaatggttgaaggaaaatatatatactcaacagtcacttaggaaggtaatacctagttgtgaaatacaataatgaaaaagtggtcaaattgccttcaattttccacagaaatagataacatctctggtaattttccacgtttttccattgacctagttgctatttcattgtataaaagtgagcactcgtatttttctgtacctgagctttcatactcacttccttttctgccaacttgctcagctgtttcgatcttcaccttctgtctgtcctcacagttggggattatactttgactttcaacacctgacatatctggaacattctacctcaaaaaagtcatttatctttatatcctttaggagcattggattataaaggttgtactttttagttttattttgtatgttttttaagggcattcacaatgcaagcatttagcttctgacattgatattttctttgcattatgctagacatttatcgtttaaacaagaacattctccatccaatttcaatgcctcctctgagagcattgtacttttatatgcatgtaagccaatgagatatgacaaatatcagtttgtgattttctggattaagtcatgctagatatttacttattaaggaatggatggaatgaaaaaaattagcatatgaagtattttttaaagcagacagtatttcttcttttctgtaggaagaggaactggaatatatgttttccccatcaaaaaatccttattagaggacatcattatctgcttataaatgctggaaatacaatttacaacctcctttggatcaaacatgatgaacaaatagacacatcatttgatatcccatatcacctttcacttaggagtttggtgtacttttcagatcagttcatttggaagaaatatggacaggttacaggatcaatgtgaaataaatgagagcataatcacactgtaaggaagcaaagctgtatagaccggagcaaagatcttcattgtgaaatcgctcttcacctttgacctacaaactagagacagtggtgtcttctgcaggtacaaaattgcctacttgctacccataaccacctccagtgtccatgacctaatttatagattaagctaaataaatagtaccttggacttgtgaaagaaaaaatgacccatgtgattttagcatgaaaggagactgagagtccctggaatgcttcctttacttgctataggatgctgttaactatgatgataatgacaaatgtaaacataacagctaacatgagacacttattctgtgccaggcactactctagtctccttgtttgtataaattcatttgatcctcaccataaacctataatgtactaccattactaacttcattttacttaagaggaacctgcagcacagctcttcataacttgcccagtagtgtcacacacttagcaagtaagggagaaggatttgagcccaagcagtctgatttcagacttcatactcttcaatgttagcttaaatggactctattgtgacctagctttcagcaggaagcataaaccagtgtctttacaaaatgctgatttctgctttagtacttgtcttcctttgagtggacagtgaagaaattgctattgccctttcatgtccttgcttggtgaggaggaacattttctgttccacagtgtagggactcttctgtccttgtctacctgacagtttggaggagaaagatactgggaacactatagattggggaggacaggaattctgagatgaattttgggctggacacgtgctggcaaatgtgatactattttagaaaggggaaattttaaaatttcacattccaaaccagatatattatctattgattattggttatgcattcatccttatatagtggtgcccagttgggtggcatcttagggcttgctcacaaattcttctaatttccacctgaagatcctggctttgggtcacctgcccaatatttacagatagggctgctcatccagtggacttttatattccccctactttaccatgtcaccactttggccttttaaaaaagtcaataattgtaatttatttcccagatcttgtcatctcagatttatttttaagaaacaaagcacccctctgatttatgatctataattagacttttatttccagagatctgtgggccaggccagcctgtggtcctatcagctcaatgactgctgtttctcacacgcaatgttgaggcatctctcactcagcacaaacctattttgctaatagtcatatactctgtcttctcaaacccaaggttctgtgtatattccctcatacttttccttaggttgattaaatatttaatatatttggttaaaaaagcctctccatttttagtatatcattaatactaacttattttataacattatacatgattattatctgtttaagatctcaccttctatttccaagtatctcatctaaaaaattccgattagaatggcaaaaataaaaaaattcctgagaatgccaagtgctaacgaggatgtgaaacaattttatgggaataaaaaatgacacaggcacttcagaaaactggaagtttcttatcaaattaaacatacatttactttacgatgcagaaatcccacttctgagtattcgcccaaaagaaatgcaacttatgttcacacaaaaaacatgtgtgaatattgatagaagcgctattcaatcactaggaactgaagacactccaaatgtcctttaatgggttggatagataaacaaactggtgcagccacgcaatgtaatggcaataaaatggaacaaactacagaaacatgcagcaacagggctgaatctcaattgcattagtgctaagtgaaagcagccagacaaaaaaccacatgattccacttatgtgcattctggaaaaggcaaaaaagggatagaaaactgattagtggtgtccaggggctaaggttgagggtaggcattgactacaaagagtcagtgtaaggaaattctggtgggaaggtgatggaaatgctccacatattgggatactggctgtagttacatggctgtgaatttgttgaaactcatgaaacagttcaccaaaaggaaggaattttacagccaggcacgctgtctcactccagtaattctagcactttgggaggccaaggtgggtggatcacgaggtcagcagttctagaccagtctgaccaaaatggtgaaaccccatctctactaaaaatacaaaaattagccatgcatggtggtgtgcacctgtaatcccagctactcaggaggctgaggcaggagaatcacttgaacccgggaggtggaggttgcagtgagccaagactgtgccactgcactccagccttggcgacagagtgagactctgtcaaaaaaaaaaaaaaaaaaaaggaattttactgtaagtaaattttaaaatagtgaataaaatatacaacaaaaagatcccctggcatcatttataagttgattgcatgttttgcctaaagtcgtagagcctgtcacctctctttcaagttgaggaaaactctctctgagcccaccaattcctggatgtcaagtttggctacaggtgaccttcagagaaggcttggtaaatccatgtgaggttagactagttgcacaattactggtgaaggtgggtcccttaactctctcctatttatctatctgccctgcccccaaatcttggccactttctaataaatattacagcttgaaggctactctgtggatctccaaagagatactgacttcaagggcaattcctctcatttcgttgccagggattttgaatactttcttgccacattgatattcatttgttttttcatttgtacaatcattcacttattgagcacttatctaacacttattgagtgctaagtccctcaccaggaactaattcctgctctctgagacccatagtctagtggagcagacaaatacgtgattgttagctatgtcacgataattgcagccatgacatagagctatgaggagacatagcttgggagaggtcagggaagaatgtagaaataatggtagctgtgctaagtcttgaagaatgagtgcacttgtttccaggcagagaagggtaggagaagggtgttccagacagaagaaagaacaagtagaaaggcaatgggcatgaatgagcacagtgtgtctagagaaacttgaggagtgcagaactgcaggtgggtgacctatgaaggggcttttgtctggagatgacgccaaagaggaaaggaccagatgtgcagggccttgtgtatcatgtcgaagaatttgtacttttatcttagaagcctgtaatgaagcatccacaaaccatgggtcctatatgaccctccccaagcccacagtcttgcttcacgtggaaagattagaaagttaccttcttgttgctgcttttaaaaaatgtctaggtgttaatattttatgtctaaactacagtttccatttttttccaatgacattcttttactcaataaagtaggcaatccattttggaagaaatacagttcagtaaaatgactttcagttttagtggaaaaaaatcagcctataaatattttaatcttttcctctggtatgtggaagggatctttttcagtggtttctgcagggaagagaaacagtaagatttgcattttagagagatcactccagaggcaacgtggagagagaaggtctctggcaagatgcattctactgctctgaaggcccaatttaagcaaatccttttaaagcatcttttggccagacaggacaacaggaagaaaacatattttcacggcatgccattttatgcaagtgggaatgcaatccaaagaaaattgtgtgcgtgctctctctctctgaaacagagaaatgaagaaaagaaagacaaagaaagccacaagacaactttccatagattgcataaaagcctgatggtatttaaattattatattataaatgattctctgctgattgtaccattaacagaccacagatagaagcattaggaaatcacagggcgatgctgaattttgtctacagtatgtgtagtttaatggactgtcttgccttgtagaattctttatcgtattttatcataattttaatgactctcattgtcatatttcagaacaatgagtctgaaaaatcttccttatgattttttagtgagtcactttgggaaggtgatgatcaagaaaaaagttggaaaaattgagacagattatcaaaacctttagaaagtcaagattttgtgttccaggaatctttagtcaatgttggtgggaaggtgtaatttcagggtaaccaatcaggaattctgtatcgaggtcagtgtaacagtttgtccagtgctttgcagaacctgtcttctttcctggacagtaagctgtctgaggctagaagccacgttcctctctgctcacagctgaatccatagtacatggcacagagcccgaactctagcaggtgctcagtgaatgtcaagtggatgtataaatgatgcctgcatggctgcagtattaatctatagaatctagggttcagggtagtcacatttgctgaattataagcagtttaaagtagaagctattgttaaaaaaaaaaaactttaaaaaaactatgcaggggtcaatactcgtcagaaaagcaatgacattaaaagtaggaagataaacaacaaccctagtttcttagagatgtttagccaagatgtttttgaattcatttcactacaaagagatcactgctgttatcatttcattatgtaacctctcatcttgtttacaatgcataactctatgtgagtgtttattttcataaaaagggatgctattgtatgttcagttcagtagcctattttttctactaatctgtcacccatatctgcattttaactcatatgtgactttcactgtacatgatcctgcttcagtatcttccttctctagtacactataaactccaagtgggcaggggctgtgtctctcttgtcctctgtctacatccaagccctgccatctgctggtccccatatcagcactagttgattgatggctactgttttgtttgtattaattgcatagtttcttattctctgaatatagcataattcatttgcttaatcttctattgttgaaatcttagattttaaaaaatgtttttctccagagtattcatagatgattttactcatattaatattagcaattatgcatatttctaattgttttagtaattattatagaataatacatgaatataatcaccatataaaagtggaaaccttatggataagggacaagtactctttaacaatcaactttctgtgcaaggagagtcataataatcagtttgagtctttttaggtcgtttctaggcttttatataatatatatgcactaagaaaatgtatgctattgtacatgtgtgtattttatacgattgatatgatgtcattcttattattctgcaaatttctctccagtcaaagattgtgtagcatttcatcttatagatctcctatgatagacaatctcttatatttcttactattttaaaccatgaagagtcgcattaccccagatgcagaccttgaaacaaggatttgagtcaggtagtttacttggaggtcattgatgatctccagagatacaagtgggcaaatgagacagggaagggaaagcaaccaatatgtgttgcttccataagtgagttgctgatgcagacaactgagactcagttttgctggggctttctgggggactgtgaaggacatacctcagagaagtcccattggaggggtgaataaaccagggtattaacccgccaactccagcacattggctggggatgctcccagggctaatcactccatacatttctgatctgccctgtgggtgggccaaacacatccctgcatttatgttcatagaaagtcctccagcagtcacagacatgcacagtaggaagctgctggtatgtggaacgacaccttctgataggatatggacaggacattgagggcatctgctataacattgttttgtgtttatggctatattttaataaatatttttgggatgatattcagattattcttttaacatttgtaactggaccttaagtcttggcttgctgtgtttcttgagaaaaacactattgcaaggcaattttactcacctgctccatcgttcagtcacttgaaactgctcctattccctttaagcctcccctcctgctgagccagccaatcaccttaacactctctgactgtcccataaacaaatgaagtctgtctctctgtaaccttctctcaagggagggtcactgctcctataggtggggttcaactgagtagagtcaagaaacctagtctctgatttaatgactctgaagctctaatgtaaactctgtgtccaagaaagtgcctatattaataccgactaaagagaatgtaatttttcctggtgctctggtggtgggactaatgatctacacttatttcgagaaggttgttaaggtttcctctagtccagtggctcaggaagtgtggtcatcataccagcagcatcaacatcacctgaaacctgttagagttgcacattcctgattccttccttcctccttctgccagacctactaattcaaattctctggaagtgagacccagcaatctgtttaaaaaagcccttcaggagattttgatgaacactaatgattgagaatcactgttctagccttttataatttacatttatcccaattattttgttcaaccaatttttacaaaataaaaagttttgagcaaagtagtaaattcctttctgtttcaaaactttttttctttaataacacatacatcgccaatgaagattccagtgctctcagtccctgcacattcatggattatgcaactctaagatacgtaacattgtcttgaaaattgcattaagacagtgcctctcttctgccaaacatcaaagattattgcaaatgtacacattaattatcttatttgcaattaatatggctaataattataaaggcatgtgccttgctgtaaataaagacataatccaaaaacaagaaaaaatcccttttattccagttgctcttcttccaccttgtatgattgtttacattcccgaaagactctgtgttgagattcttttacatgaacatatccttcttgcatgtaaaatgacctgattaaaaataatggaaccaacaaatttgggttaccaaaattcagtttttgtactctccaagagtttatgcatggattaaagttagagaacacacatatatgcctttgagttgcaatggcaacattcttactgagaacattatgccaatcatatagactatttcatgcatctttgctccatccctgtaaaggacagatttttttttctcccattttcctgatagggataactcaaagtggagaagtttagaaactgaacctgggttgaaaaggtttggaaactaatactttgctcattttttccattcaggtattgaaaactctttattgagtgtctgctatgttaggcattgtgctaggtgctggagctgtgtggagaagcaggacagtcagccagagctttcggtctagaatgggcaaaagccatgttctctaggacttttcccactataaaccagagttttctcaatttcttcacctttgattcgaatgtatcttatctacagtaaaagataaaatttgggttatgctggtgaaggaagggcatagaggacccaagaaggtatggcttgtggaacacaattctttatttcctatctgagctcttggttcttcacataccatggcttgaaaatcatggacctggagtagagattgcaaacatatcttacaaagagctttggctggacaccatccgtgctgttatcatattgttcaacaattttgcattatttgccaatagttttaaaatataaaaaaatccagattttctactttaatgggaaaattgacagacctggccacaatgagccttctttttctcatgactgacctccattcttcatagactcctcacccctccactttcagttttttcctaccctaatttgcattacctgccttgagcctgtagggtactgtatttatagacataactttatatttgggaaactaaacaatatagaatttccccagtgtttgagacataataattctttacatttgtctagtgattacatccttgtgcattatatctagcagatattgttttcaattttgatcaatgaaaacattaaactttatatattgctgggcacagtggctcatgcctgtaatcccagcacgttgggaggccaaggtggatggatcacctgaggtcaggagttcaagaccagcttgaccaacatggtgtagccctgtctctactaaattaaaaaaattagcttggtgtggtggcacatgcctgtaatcccagctacttgggaggctgaggcaggagaatctcttgaacctgggaggtggaggttgcagtgagccaaggttgtgccattgcagtccagactgggcaacaaaagcaaaactccatctcaaacacacaaacaaaaactttatgtattatatttaaatagagcaccaactatagctgtgcatagtctatgtgtttatgcactaattttcatgacatatcttagaatggtagtatttttgctactgttttatagttgacaggcacagaggctggtgactccagttcaattcctcaaaccttcaagcacacattaattttcattttaatcaccatttaaattgtgccattcttttgttttgttttgttttgtttttttgagacggggtcttgctctgtcacccaggctggagtgcagtggcacggtctcggctcactgcaacctctacctcacgggttcaagcaattctgcctcagcctcccaagtagttgggattacaggtgcccgccaccatgctcggctaatttttgtatttttagtagagacggggtttcaccatgttagccaggctggtcctcacgtgatctgcctgcctcggcctcccaaagtgctgggaatacaggtgtgagccaccgtgcccagcctatattatgccattctgagtttgtatgttaacagaaagagagtacactgctttatgtaaaaaactgacaggtgattgccttttgcttcactctttgttgagtgattctgctgctacttacttaaagtagaaagtggtgatactggaaggataaaagggactgttaaaattgtctttgcaataatttattatttttgttctttataagccacctaggtcccctgagcctctgagtttttctataagggatggaagaagacttgttttaaaaaaataattgaaagattaacttgcttaattaatttcctttaaaagtaaagaactatgcaaatagaataaagaatactgctcagaagccacacatgaaaaataaagaagtgagtccattattcatagaattttctatgagttctttttctctggcatctaaaagtgaggctggacttttgccttttttccctctgaattctaaaagaggctaaggctgcttgcaggatttaaacattttttctctcctagatttctttcttcccaggtcattttacaggctcttggatgttgcttgccagagtcaaaacctgcctgtgttgttgctgagggcatttattttgaagtgggctatttctaggaatgcatgtaggagtcttcaagaaaaattcatttctgtttttttttaacttattttttattataccttaatttctagggtacatgtgcacaatgtgcgggtttgttacatatgtatacatgtaaaaaataaaaagaaagaaaaattcatttctgttttctgacctagaaccccctgcccattatcccagccaaccttttccactcagacaaaaaggctaggaaaatcacagtcctcaattttaggattctactctttgaagacccaagtctggtaccatgtttcacaaacatactgtgtccttagatttggatgagaaccctttctgttacttcattcgtttgttccttcattcttctttcctaattcaacttctctcctagttcagactcttaaaggattatgaacttctcccttgcaggacttactgcaattatagtgttacatttatttttaattcttctgcttttatctctggcattttaactcaatgatggtagggacttttgttcttttatggtttgtcactgaaaccctagtgtcttacaaaatgatgattacatatctgttgagtgaaaacgtggtaagcagcttgtgttgtccatttttatggctctttgttttgctcagaaaaaaatctgaactttctgcagtgacctaagaggccctggataatcctgcctccagtcacctccctgacttcacctcctgctgctttccctcttggctgtttcactccagcctgggcctgggttctcccatggtttaaggaaacagatatattctcttcattcaagacactgaaaacaatttcatcttcttacattgatatattgacattgatagtcaaataggagatgaaagtagagagagagaaagtgtgctactaaagaatgaacatggaattttagaattgggccagaattcaaattatggtccagccacttgctaggtgttagaccttgggcaagtttcaaaatttttctgggtctcttctcccagtctttaagatgggaatgataatactgttgttgcagaaatgttgtgaggattggacataaagtggcaaaattactgacatatagaagttaattgatagtaattattatcacatgttcatcgtaattgtatgaatcggctattgctgtgtggaaagatacccacaggaactcagggcttaaatagtagcattttctttttctgcaggcctctgtgggttgactgggggcacctcagctgatctcagctggctcacttatacaactaggagtgtgctgatcttggctgggagtttctgctctgagtcgtggggccagttagctgaggtctgggtctgctccttgtgtctcattctctggcctaggtagaagggcattagctatccaaatggagctcttctcatggcaatggcagaggagcaataggggaaaaataatacaagagacctcttaagacctaggcttgaaactggcacaatgtacctatccctataatccattgaccaaaaaaaagtcatatgtgcgagtccaatgttcagaggtggggcattacattttcttttgttagataaactacaaaggtatctggcaaaagataagaatacaggaagagctgaaggactgggaccaataatgtaatccaccatagttagtattatagaaaattagatacatagtcaggaaatgtgggctcttctgcctttaccacaaattgtgcggccttgggaagctcctcctgtaagccttggtttcaacatctgtagaatgatgagattctgctactagatatatggccaatgggcttggtcttgagacttgagtcctagtatggagcgactgggaatagtcaccttgcattctttaaggacaaatacggttctgagcttgattgattatgtctagcttgggcactagggaagggagtggtggcacagatgatgtgtatgtattattctgtgactagatgatttctttagtccttttccactctttaatcattcatttcgttatttttcaagttttattccattttgaaaattaacaaagggaacattcttaggctgaggacactttgtactttcgaaaagactttattcataactgactatgagctgtaaataatctgaagtagcattctagtgatattgtcataaattaattactaaagttttgggaattagcttagtgacatgttttaaataatttgcccccctggaagtatctttcccctaataggtttacagctcctcttagatttacagtaattccttcatttttctcttatctccattatttatgtaagccatattcccactgaggatacttacttttgcaactgcagtgttggatggaatatagtgattctggcggcggttttcaggatttgaaacaaatccatatttttatttagtttctgtactacatgaaaaattggaacacaggtctagatgattttttttgtattgctgcctatattgataaggttatatttaggtgactctgattgtaggagtataaaataatttatccttaaagcaaagacatagttaaccgacttctaaatgtataactatttcattaattccagaaaatacttaatttcaactttattaaaaaatttttccatgatgaatacactctctcacagttgtgctgctaagtttgcaatgatacattttcaactttttaaacaaatgtttggctgtaagaatcctagaaataaatcagcaaaattgtccagttagggtccaattgtcttattgttaagatcaatgttgggtaagttgattctttgatgataaatattgattgagtgcttactgagttcaagcatcatgataagggtcattcatggattatctcatttaattcacataacactttatatggtgggtaggccaactgaacttataagtagatagagatttggagaggttaagtaacttctttggctagacagtcagctattgatagagttaagacttgaacacagcctccagtcatccccagagacctagctctagatcctgaatggtactgtacatgctgctgtactgtatctaagataaggttaagcctgatgatattagtttatcctggcaagtattatagtatcacataaggcatattgattttttaaaaaaccaagtatgtacctcttgcatcagaagttgttagaaatatgcaagcactgtgtttaatatttgaatacagcttttgcttcattcattatcttagtgtgatatctatgaaaaactgttttaatattgaaagtagttgagctttatctgctcaactgttctcatccccatgagggtaggcaagctacagatgctacacatattatctttataaagcaccgacagtgagagcagtttttctttctttagacaagtctaggatcttatgtggcgacaatagcacatctttcagcttaggaaacttttatacagattctaaatatccttcttcagatgttgacatagacccacatacctggccccagatatgaaataattctggaacaaccttccagttgaaataaagctcacataaaatatgagaaaaatgcataaattcaagaaggggctcaccacaaagggatggcatagcagccaactgaattttcacagaagggaaagtttattttatatgggtagcagccacttttaatgaagatgggaagccctcatctctgaaatgaaccagaattaatgggatctattctttcttttggaaatgccacataatttcactggatccagctgtcaaggagaaacacccttctctgttaacagctgagtggattggttacactatttggctataaggaatagagactcaagttattgtaagtaatgaaggggagggatatattggcaatatttacatctatggaacccaggagcacaacaacctgacctgaagaagacacctgccaatataatcacccaatagacacaacaacttttgccattaaaagtaatggcaaaaatcacaattacttttgcaccaacctaataggtatgatagctgtagagacttcagaaattttagaagcttctgactccatcactctcctacgagagagggagactcaatcactgcaagggccttccagattatgcgaatggatgaagttggccacatgcttgtaagggatgatgcttacagctgcagtaaccatcttctgagcaagaggaggaacccaagcttaattgtagagaaatcaacccagagcctagacatcatggaatcatgaaggtaacaaaccccagaactgcctgtttcctttcttcctgctttatgaaatgtaagtgctgttagttgagtactctgtttctgacaagtggaaacattcttatactccctctgcaaatcattaatattaaataatataatatctatgattataagaatgtattggggaaaatagacatatgtggggttcatgaatattgaagacgggcttatggcagggctgtcatgtatagttggagggatattttcaaattagaaaaaatttgtgggtaagtagtaggtaaatatattcatggggtacatgagatattttgatatgggcatacaatgcataataatcacatcaggataaatgaggcatctatcaccacaaacatttattctttgtgttacaaataatccaattataccctttaattattttcaaatatataatatattattgtcaactgttgttattctgttgtactatcaaacactagatcttattcattctccctttccatatttttgtacacatcaactatccctagtttccccttctccccctactagccttcccagcctccggtaatcatcattctactctctatctccattaaatcaattgttttaattttttcagctcccacaaataaatgagaatatgtgaagtttgtctttctttgcctggcttatttcatttaacataataacctcccattccattgatgttgctgcaaatgacaaaatctcattctttttaatggctgaatagtactctattgtgcgtatgtaccacattttaaaaaatctattcatctgttgatgtacactgaggtttctctcaaatcttggctattgtgaataatggtgcaattaacatggatgtgcagatatctctttgatatactggtttcttttctttggggcatatacctagcagtgggattactgaatcatacggaagttctatttttagttttttgtggaacccctgaactgttctccatagtgattgcacaaatttacattatagctgggcacattttttactgcacatttctagggggataccaatcatagcctacaatgtataactatatgcagtggctttggcttaattactcattttctctaagactgctgaagttcatagaaatttccttttttacaactcataggctattaaaaggaaataaactctaaatctttgcctacggtgtctagagtgtctattgaagaaaggcttttctccttggggagcagctcttgctcagccaccaggtgtctatgtgacaggcagaatgatttcagtgcctctcattgtatgaggattgtgggctgcagatgaagaattatggtagctgtctatcaatcaagtgtgtgggtttttttaatccctgaagaaaagagagtgattatttgtttgttttccaacactgaagaggagaagaaatgtcatttgtgttgcttggcacacatgaattctgcatctcagtaatggaacctggacagaattgtactactatcaggcctggggaaatggtagccctgataggttacttggagttggagggaatatttcccaattgaggctggtagtggagcacaagcaaaggaggtgtacagatgttaatttctacgactggagagaggaaagtttccctctgtccctctcacttgtctggcaacacagaaattgactgccatcataacagaagctctgtcctttttaggtggtgaggggaaggagcagggagagaacattttctgcatattttttttccaccctcaaatggctttcatcccgctctgaataaactcccaaagatgttgttcatgattatgcgtttatcctgctttgtagagaaaggggaacagtaatactcagatactcccataaatggctgttctgtgggagtggtgtggataagaatgtggactctggagctagatgtcctggctcacatctccaattactagttttgtgactttgtgcaggttacataacctctctgggccttagttttcttgcctgtaaaaatggtgtatcgtagtttattccctcagaaacagactctgaaacaagaattcaactataaatagttcctttggaaggtgatgccaggaaacatagattgggaagtgaggaattacagtagggaagaagaaaaaaccattgaaggatgtattagtaaagcagttaccactgtgaggatgtgggtactcaagagagtatagaagagcccctgagcaatgtatcaccctcagactctttgaaggctgcatatgggccatttatgctatggcacttgccacttgtcctgtgtttgcatccaatgtgctcataaggcgaggaaatagaagccctcagggtgtagaagtgaatgctgaggggatttggctggggatttgggctgggcaccaccatcgtctgctatggcacgtaatgatacttcactgagttattgagaagattaaatgagtttgctgataggaatgtgtacaaaagtacctgacatatagtaagccctacctttgtgctggctgcctttcctattgtcctcagcagagccttatgggtaagagcctcgatcccagatagggctggattcaagttctggctctgccacttactatttaagaggccagattttcagcttctaaagcaagggtcagccattgactaacttttcctgtaaaagtccagagaataattatatgtcatcttagccagccctgctatcgtgactgctcaacttagctttttagtgtgaaagcaaccaaagacaataagtaaatgaatggttgtggctgctttccagtaaaacttgatttgctaaaacaggtggtgggctggatttgacccaccagccactgtttggcccataagccaaagtatcttttcctacagctgcataatgtgagaacaaacagtgtttacttctcagcacacatactaaaagtacagtctatgtcaacctgcctggtattgtatctcagcttgatgactttctactttggcaactatatgcacacatttattattgttaaccatcagttttctcatctaaaatagggatgataaatatacctggctcgtagggttgttggaggagatggactgcataggctaatccatatgctaggcttagagtatgtggattacagaagaagtgaataaatgtttctattatattcatttcaatttctactattattgtgctttcttcctggcagaactcactgcaattctattggagaaaagacaacagaatagttcttaagattcttactaagaatcagatctggcagagatatttactagttaaaattgaataacctattagaactgcatggattcggatcagtggttattaaccaggggcaattttgccacctaggggatatttgacaaagtctaggaggttctttggattgtcctaactagggaagagtgggctactggcatgtcatgggtagaggtcagtaaaatctaaaaatcctttaatacaggacagttctgtacaataaaggcttacctggctcgaaatgacattagttttcaggttaagaaactctcgtttagattgtatatatcacttctgaacttttaccctctaatatatggcactgtttatatcatagtatttcacatgatttgcaaattatcatcatgatttctctgactcacaggctttgaaaagatgtatggaaatattttgtcaagataagtcaatttaggtgagaagtgtttttttttaacaacactatcgtttaaaaaatacaccaggtagctagctgacaaaactacataattaattttcttctaaaataattttaaatgttggagagtctttttaagaatacaaatgacattctttgcattctataatttctatgaatataggacaatttgagaagataaaggacagactccagaattcctcatctttgttgtaatttaaggaagtctttttttccataaattactaaggtgtctctgtcaatgaaaagtgtgcaaagctattatttacacctgtttgactctcaatattatgatttcatgatttttgaaatggaatatccccattcaaaatgctttctgtactgaatttcaccacactggagtgattgttaatagctctttgctgtcaagaaaccaccatgacctcttctttctcttattttctaagtattgagatcttctctcaacttgacagatgaatttgctagagaatttttattaaacaatggccctaaacaggccatctccatcaaaccatcccttctcaatggcactcttttttgttttggtactcaaatttcacctagatatccccaggttcctgtgactactctgagtcctccaatgtcctcacaatgtttttaaatcctcctctaacccacgtggaactttggactcattaaagaaagaaatcctctgagaagatacatctcataaattaggacacagaactctgattgggagctcttgatcagcgaacaacttacactcttacttggcatttctgaaagttttatactgaagctaggtatgtcccctggctttacatcctatttggacatcttcattcactttatttgttatttcatttgttcatttcttcactcaccagcaaatatttattgtttccattatgtgcctggcacgatattgaataagacaacatcctctatctgactcacttatgaatattgtgtctagtgttaaaggataattttcaaaaaggtaaaatcatgactcccacaaatacaacatgaacacatgtcaaagatttatgtgacttactaattaataaggggaacaggaagagtttataattggttcaaattagaactggatttacaaagatttataatctctactggacaatattcattttcactgccacaagcaggaataatttgccttgcattggacaggaaatgtttacttcactgacaccatcagcaatttaacttctttctcctgaaagacaatcaaaagtgtgtgggtacccagtgaaatcagattacccctggagtatctgttaaacttcatccagcattctatagcagtcatttctggtccatttcaaagtcttcacgactttttctaacactagcacagacaattttcaaatatgaacattgcagatatgatgagtccaatggcagaaataaagtagtgtgttgggaaacagagtagttggtgggggtggggacttctttagatggaggagccaaggagaactcccctgatgattttttaattttactccccataggttgcctatttaaatcttaacagatgtgataaagaccttaatctacatgtgacaaatgttggcatttaagccatgagcatgaactacctgtagagtctgatggtactttttctagtaggaatggaaacaaaatcaggtctacctactagatactctctttacatttctcctccaaaaccttgacatctgtattttaatgtatctatttacttttatgcatgctatggaatctgcctctgctcttcattttgataacattgcatttcacagtaatttgtgggatgtagagacactcaaacggcaaattaagcttccagcaaagcagagccacaaaaaaatgagaaatcggttccttggaaaataattttagattttattttattattttttagagatagggtctcgctctgtcacctaggctgaagtgtagtgatgcaatcatagctcactgcagccttgaacttccgggctcaagccatcctcctgcctcagcctcccaagtagctcagactataagcaagcaccatctcacttggctaatttttaaatttttttgtagagatgaggtcttactatattgcccaggctgatcttgaacttccagcctcaagtgatcctcctaccttggcttctcaaagcactgggattacaagcatgagccaccatgactgacctacttttacattttaaaaagtatcaaaatagccatcagagaaatcacaagttttctggactccccttcacagatatgaagttttaatttttatgtgcactagcaattggcaaactatgttgctatagtttggatgcttgtcccttccaaatttcacattgaaatgtgatccccagtgttggaagatgaggcctagtgggaggggcttgggtcatggagatggacctcttgtgagtagatgaatgtcttccctttgggagccaggggtcaggggagtagggagggtagtgagtgagttcccactctattagttcccaccatagctggctgttaaaaggagcctggcacctcccctcctctctctccatgtgatctgttcactccagctccccttcaccttctgttgtgagtggaagcagcctgaggcccttattagatgcccaatcttctaggcaacataactacaagccaaataaaccttttttctttataaattacccagccttagctattcctttatagcaatacaaaatagactaagaagacatgtggcctgtggaccaaatctgatgtgctgtttttgtgaataaagttttcttgagacacaggtacactcattcattacatattgtccatggctgctttcacactacaacagcagaggtgaatagtcatagcacatactgtatggcctgcaaggcctaaactgtttactatctggtgctttacaggcaaagctttgccaacctctgagtttaattgattggggttaatattattcattcatttgtttattcatctatttaacagacagttaacaagtagctaccatttgccagacactattttaagatctaaggttatagcactagttacattattagacaagtttatgatcctcaatttcttaatctagtactacgtatgtttgtcttttatttatttggggtagactatgctctgaagtttttataatgagatatgtacctctatgccttggtttagggtctcccacaagcagaccttcaggcagttgttttggtggaggcatcttatttggatggtaagaaaacatgaacaggagtggggaagtatgaaaggaaagggaaggcagtcaaaaaagagttaattaccaagccacctgccatagtgcgtgatagaaacttaatcccctgaagaaactctgggaaatctgtaaagcacacaactcagaaacacctcacctaagggctgaggagcagaggaatttataatccaactcttaagtgtcatcggtagatactcatgtgtgtgtatgtatgcggggggcaagaggtgggatggtttgattctttgtttgccttgtatggtgaatgcctccatatcaataaactccattacccagcactatattttgctcccttcccctaccccaagggtacagaactctcaaagttcactgccacacctgttttcctagtttcggtagctacctattaaccagaacttgaaacacagttattaaataattctttacttcttgaagcagagtaagtgcttccttactcaagccatattagaacgtggggacagatcttgaggaaggcaagtatcatctcccaaggctgcctcctaggtgaagcttctgcttggtctcccagcaaggaaaggatgctatattctaagaataagatgtagataacttctgaagtctcagagggttaaggagaatctgagagttcaagagtctggagtgcatttacacagatgtccctttccctggacatatctcagggttttccatcttctttatctatgctctgccttagaatgttggctggggctgttgcttcaacactctagacagttctctcacatcaggtcctagccccgattttcagcctgatcttttctctgcctgcagaagatgagagtctctttaaatgatgccggagaggcctctggctttccatactgaaccctgggttggtgttcagctcacttgagcctgtcattttcttctttcagctcattgatggtacttggtccaactatccaattccataatctttccaatggccaatgccaccctatctctcaagtgctagagaaattgcataagctagtgcatcctcttccagctgtgccccatcccaattcaatcttaggtaagagtctcagcagttatgatttcatagcacaccattccactcgtgactagcaatggtaattttgttgccattttgctagtttctagctgcaaagaccaattctagagatctgtttcctaggaccactttgagttccaacctgagttctcaggttttagtactgaaagtcccacatcctgaaaagctacaagttctaggcaaatttgaaatgcttttcctgggactgtcttggttttaaaattgcaagtcccatgtcccaggaacaccctctgtccttaccaaaccagatgggtggtcacccaagtttcaactgtgtaattactccagaattagatcctgaggtagatccaggtttattttggagatgcaaaacgctttaatatgatacagtgaagataagacagccaatcaataaaagaaacattattaagccagatatcccagtgagcaaccagagcttaatcccatgggaaactccaggaaatagggcaaaacacatgcttcagaaatttcccagtagagaagcaagggtgtgggagatttacatgccaatttctgagagtcattggcaaagggctactcctagagggttttaaattccaggcactttcagcctgctggccacgaatagtatggtttgattgtagttccaagaaaaaaagcaaattctggcttaagtatgcagacattggcagcaggaatttggtgggagactctgaggggtctggatgagacgagtagggaaaattagcatttgttactgctcaccccttgcaatacccagatccatttgtgacccctgttaagttgacatcatcatagtaagggagtggctgactggtcacgacttattacaggagtttttatgggaaaagctacaattctgcccatcatctctcttctctaacacacgttttaggttcctctgcccttggccagcaatttgatttccccagtgagggcagagcatcctctcctgaacctgaatcaatgtatatttcaccctcttgaattgggagctaggaatagaaactcatagtttgtagatttggcagtgtgataattcaaatgctgtctaatggtccatagttagagatatttcagttatctatgttatggggccgaatctcatcacttgaaacagaactcctgtattcacccaaggccagctcgttctcatcagtgttgaaaagaggtgatcctgtgtattttcttcatccctctattgcacatcacattaatcattttactgcattaatgagacaatatcaattccaatgcttcatttaaatatggaacttcatctcaggaaatgtgctaaggtggaagcaatctgcttcctttccctttttatacattagaaacaatttttaattgtaattttataacttggtcattgcagtgtgtgatatgcaaaataagggctctccctaaagatgtgcgtatcccaatccacagaacctgtgaatgggttaccttacacagcaaaagggactttgcaggtgtttttaaattaaggatcttggtatgggaagattatcctggactacctgagtggattcaatgtaattacaagaattcttgtaagtgaaagatacagcctccagtgagagtcagagaaggaaatgtgacgacagaagcagtgggtggagtggcacaatggttggtttgaagacagaggaagtggtcatgaaccaagtgatgtgggtggcttctagaagctagagaaggcaaacaatggattctcccctagaaccttcagaaggagtgcagccctgctgacaccttaatttaagacacctgaaatgcatttcagacttctgatctcactgcaaggtaatacatttttgtattttaaaccactaagttcatggtagtttgctactgcagcaataagaaactaatcacaggtgtaaaggatgacaatcatctttgcagctgaagtggaagcagtgatgtctctacttctgctggaactatagtatagatgctaataatctagttagtgaaatcaagttcacagctctatcacttactcgctatgtggccttgagaaagttatgcaacaactttaaggcttggtttcctcatctgtaagatgggggaaataaggatttgtatcttatattgttgttataagcattgagcaagataatttagaaaatgcatttaagagagttcccagtacataataacagctcaaaaacattgactattattgcaacataacaataatgatctttattttgtgatgatctcagtttataaggtgttctcacatatgggtgtttaagcttgaatcaattctgtaagatcattttccccttctctcccttaccatttcccagatagacacatagagtcctggggaggataatgaatgttcacaagatctctgagttattaatagacatagctgagattgacttctcagttcttcactgctgagtcaattttgaaaatataataagtttctaaattccagaggtaaagaaaaaaatgttcttaaaacgatacacaaagccacacacatttagtaatgtctctcagaaaacaactggctgctgcttgttgaacagagttgtatactgatacctgttttcagacgtgtaaaagctatagttttattatttttaaatgaatagtccatagaaaaaggcttgtataacgttttctatggctgctgtatctttgggttcagtccataactatttacaaagatgagctctggtggcaaggcaaaaaagggttgtaaattgggaggtttcaggatcagaagccacccagtgattgctgaagatgagaccaaattgtggagatatttgctattatatataaaattcccacatgataatgagtaataagttattttttctatcactttcatggtataaatgatatcaaagcacttctttactgcctcttcaaactttctccaggagctgagaagacatattggagaaaatttgtgtgaacagcctggagaagaagaccatacaattggaggactatgacttatatgtcatttataataatagtagcaatagcaaatgctcgttgggtgcatggaaagtgccaggcacagcactaatcacacactaatcacacacacgcatgcacacacacacacacaccagaaatgttatatatatatgaaacatttgttccttataacaaccctggaaagtagattctattatttgaatgcgtagatgaggaaactgagacagaaaggctaagtaacctcctcaaggtcacagagttagtaaatggcagagatgggaattgagctcagggagccaggctgcacagcctatattctacctactaataagctaccctggaaggaacagtacccatctctgagagagcagaacacaggacaggtgggttttgagagcaagagggggaatgctgggtagagagtgcagatgcaggtaagggaccacagcagtatcttgacctctacagtaagaaaggggcactcagtgtgtgtctgcacaatgacagaggggcctgggatatagggagccaataatgaatagtctttatctagtccacagtttagccaagggccagccctagctaaatgaattaaagaatcagagaaaataagatcttttgtaaaagtgtgcttgtttgatttactgactcatttgggaattattaacccaagtgccagggtggaatgagcataattgtttttacttagaagagcacctaagcctaaattgctgggtgcaaataaatctattcctgggaggcagctggggagcccccgcaggcttgttcctggcctcctcctctgggggctagaggagccagctaagcacacggcattctttaggctgaagtgagaatttactcctgaatgctaaaggggcttgctccatgtataatcaaggcttactgaaggaaaaaaaaaacacacacacacgcacaaaaaactgggaaggaaaatttatttttgatgcctccatatttttctctgacttatgtgcctcatcacctcaaaagtccaccattgcaactgtgtgtgtgtgtgtgtgtttgtgtgtgtgtgtgtgtgtctttcagaatctcctttttccctctggggatgtcaacttcctaaattgccagtgccctcacaatttttcacaatccctgtcttcctcagccttctcctgtggcaccacctccacacagcagcttcaattacatggtttccatgggtagaaacaagcaaaggcagacactggccataaaactgactgatgcaacttcaagttagcctggggcagatatttttaaagaacattgttttaggccataacactttaccttgacggagtgaaactaggccggtagaatttcaggcagagaagcggacaggtgtgtggactattctagaccagcaaatgagatggtgggtccttctccagaaatccttgcatcatgtttttacagtaagcttcttgtttgcttatgcataacattactctggcccctgtgaatgtggagaaactggcctccatgtctcttgggtcagtctctgttgagctgtgggtctttgtcatggatgtcacgtacatataccttagagaaaagataaaagagttggaggggtgggcttgagaaaggctgtataattttattgagcaatatttcttctttaaatgggctcatggataattcaattagctggcttttgattgctcttgttagtggttaggcgctatataatgaaaatatggatttgttcaagtctcaccatcacaaaccagcttgtcaggatggatgattcaacagatccacagtgggtgtgacataggttcaagtgtgtactgaccatattcctctttagcgtgtgtgtactctctttcttgctggctctctctggatctctttctcagctttgtttggagatggagctaacagttgtagaaaataaatatctgcctaaaccgagtggacagcagccaatgagaatactgtgaaacttccccgtggaaagctccatgacatggcatatgcgagtctgtctctctcattgatgctatatgcagacggtatatatcagctagaagactttgaaaaggagatttattaagtgtcaggttgagagttgtgttttcatcttgattatgaaaatgatatataattttaaaaacaattatggtgcttgataaatttctctgtttgtataaacttcccatttcaggaattctacatgtaattcagtctgtgtgtcctgagagaagtcctgagaaaggagaccgagtgcattcagcatgctagaatgatttctccatgagaacaggttaaaaggcatagtgggaatcagtgcagggatacaaggtctgagtaggaatggcatatacatcctcagaattaaagagggtacaggcaggatgaaaatacacttgtttatcacatcactgaaagctgggaagggggatttgcttgaagcttgaaagcagtgatttaagaccagaatcacaggtgcattttgcataggtcataagcactattgatcatgtgcagtgtcttgaaagggaagtagattccaaaaaagagcagatatgtacatgaagaataaaactgtagttgacgattaaaggtacattatgaacactcaagaaatgtctctatttttgaggatgaggtcatctttctccacaaaacacccttcaggaaaggagggggaggttgaaccactggtgcagcatggtttctctctttttgtgtgccctgaatatatcacatttatccctcatcaaagagaaatttttctttttattgggaaatgtagaagtgatacctcaaacgatatggtttttgtttccaaagacatggtagggggttcaatgcttccaaaaaacatatactagacataagtatgtggtattttattttagatgctatcagttgatcttttgctactacatttctaacagccaaaacctcttagtgactatcacttatttttttctttaataatcttatttttgtgtagactaagtagtctcaaaccaagctatttctggggttgggaggaggtaggtaatatagactatcaaggtgaatcaagggcaccgcaacaggggatggtgaggactgcaggaaactgaagctcctatgcttttgttaagggagacttctgctactcagtttcaaccagtagttgccatatggggcttcaggcccaatattgtgatcctaggcaaatctttcaaagagatgccacaaacatggtcaaataagcaaagtttttttgtcatttaaaataatgcgcaggtcctgaaagactagttcatgacttctggagaataatttattcttgggaaagtgaacaccaaacaaataaacagcaagaacaaagcatgaatgaaacaaaaagcaggttcttgaccaaaccaatgaaaataaaatcaacaaggaattgtgacttcctatacatatgcatgaccctagggtttttccaatggaaaagtctaaaccataagctgaaattcctattctctgctagctgcacatcaagagtggagacaaatatttcagtttgaagtagtaggggaggattcatagaagaggtaatatttgaattatgagttgaaatttggatgtggcttggttaagagataaccataacgaagaagcagtcctcatgggttgaatgaagggaagaaatgctccatggtggggaaagttaccaattccttttctggggaaatagtgacaccaaaagctctcaaaagcaattagctaaaagcactagtttttgacagtcttcagtggcagtcttaagtctgaactttatcgtctaacaggtggttgccaactcaaatgcccacaggggccagacaggtaacctaaaaagaaaaatgattttggagaatgggacactgtatccagattaaaaaaacaggctcagctccagtggatccttgccacgtagaaatgcagcaccagcattgcctaagagaagttcgaaatctgggtttttatttgcaagttagaattttaaaatgttggcagcaaattcacattaaaaaggaaaagtgtgaatcaaagcttatttgaaatcccatatgtaaaataaactcagggctgcgggtgatgagggctgggattacccaggccccagtcactgagctacatactttcccttcttgagctaacggtgggtctcatcttagagaacgttttaaatactactgctactggtaataagaaaccattaaagatgcaataaatttggcatgcaccataattatacatatgttttagaaaaaagtttgcgcatggacaagaagtataaaatgaaaatagtttttgaaagtaaaaatatttttaaaaggttacatttcataattataatgtaaaatttaagttagggaaacattgattaaaaatatctttctagagtcttgtgactttgccaccaatagaaatctcaggtatttttatactgttgaaatgcagatggcttgaaaaatcacttagggttcttactacaggtattttgaaattacagtcattattcagacctgcagacctgcagtcagattatgttctttaatgcattaataaagaagcatacatcttattatatcacacatttttaaaatgttatttcattataattagttttctttttaatcctttattttaaaagggatgcataggcttcactggaccactaaaggagtccatggcacaaggaaagttaggaaggctgttcggaaccagtgtagcagtaaataaaaagattacccactctggcgatgccagaattgcttttctttccaaagatttcctacccccaggtaggactttttacctttccaatgtgagtttcctgtggcttacaggaattcagctggaatcctacattactctgcaacagaataaaaaacaaaacttaataagttgacaacttaaagaaaaataaattcaaatatgtaaaagcaaaataggggagaaccggcagaatgctgctgtgtagcaaacccaggtggagaggtaaaaacgtgatgaggtgggaaaggaagacggccaacgtggatcacgtgaaaaaccagctgggaggacattttctccgaaaaaagaaatggggatagttgatgaggagtcaggaggactctctgggctcttttaggaaaaatatcttctgaagcatattttttttattacctgaacagtgatgaaaggacaaagtttcagtttcctagggaaatgcactggctgtgaccaaattagtccagaatttgctattatttaaatgcagtttcttgtatttattaaaatgaagtgactgtcatattaaaattgaaaacgagcagttgcacatgcaaattatttctaaagttcaactgctgctaaatgagacgcggtgctcttaaacttagaaatgcttaacataaattatgacctaattaacatttgcacggtaatccggacttcctacagctttttctgctaattaacacatgacaaatgagcatacattaatattttattgtaacatcacttgtccaagaaagcttcttaactcctcagaaaatattttgtgttttgtgtaattttttttgccattttctgcttgagaagtatcctattgtggtttatgccattgtataatattaatgataaagttgtcttgtgttgtaaatttaataagatcagcaaagatgcaagctctaggaatcttttatcttcatttaaactcttttctttattctttctagggaatatcagcatttttgagaaaaaaataaactaattgccttgatatgtacatcttagctaattatcactttccatggttggttgcctcctagagctatgggttcatgagtaaaggtagacccatcaagaagagcaaaatcatgtataaggctatagattttaagctttgtaagtggtttaattttgactgtatattcagtttgtgtcatctgttatctaaattgtaacagccctcaaattagggagatcagaacacttctacatctacaacagacagagagcgactaactatgaatgtctactgtaactttaatttttattggggcacagcttctcagttttgatttgctctcctggtatattgcaggggtttttgtttgttttaatttgttttacttgggattttccaaggatgactgcagaatacatttttatctgatcacataaatcagagtctgtgatctttgaggtctgggagattttctcaactagaaagagagcatcttgctgtgacgggcaatgtattgggtgttttgcaagcacattacaagggcacgtaatgaacgactgatagggtcccagtgtcttcccctttatgtttaaagaaacccttgaggttattgagcactttcctgatgaatgcttgaatcctattcacagccttccaaacctatttctatcaatgccttttgacttagaactcacaagggagccagtgaaagtgctggagagtacaaattgtgagtggagacatagatgaatttgtatatgtgtgtatatatacataggtagatatagagacgacatatacatatgtgtgtatacatagatgtttgtgtgtatgtgtgtgtgtgtatatatatatatatatatatatatacacacacattacctatgcctctgtctattgatcaatctatctatctctttatttttattagctaaaaattgaaaacaacccaaatgttcattgacaggtagatagagaaataaattgtgatatatccatacaataggatgctcagcaataaaaactaatgaactattgaaatgtgcaacaacatggataaatgtcaaaatcattatgccagacaaaaatgtgtacatactgtatggtttcacttacataaatgtgtagaaaatacaaacaatagtgataggaagcagatcagtagttacttgggagggggttggatagagattataaagcagcaggcagaaattctcttgattgtagtgatggtttcacaggtgaatgcatatatcaaaatttatcaaatcatacatgaaatatttacattttattatatatcaataaagccgtatgtgtcatatatgtatgtacacatttctgtgttggtgagtgtattgtttgtttactcttttttttgccaacaaagtattagttccatgagagcagataagtttatctttggtccagtgctatattccagcttctagaatgtgcttggcacatagtaggagcttgataaatatttgggaaataaataaatgcaaagaaggcatatacacctctctgtagatatatgtaagcactatgcttctgcttttaaatgtgtgtctgtctaaagaacatcaccatctttttctctatctgaatggtgcaggaatggtatatatctcagacagttctggaaaatataaaataatttcaggttgcaaagaactgagcagtacccaggttatacagaataaccaggtagaaggagaattcaactgtaggttgagatacagtagattagccaaatatttcatgagaggagctgaccatgaagacataatttctgattttcacaagagaaaaccttcaggtgattctgggaattatggtaagattataaaaggcatcaagaggcaacaaaaagctgaggcaggataacctgggactaagatctgctgaattcaggacagagaggaagatatacaaaatagctgggaagaacgtgaggagggaactctggggtttttataagctgatgcctctatttctctgtcagggtgggagagtgacagatttccataaggcacaggggtttttaggggcaattaaataaaaatagtcaatgctgtaaagtctttgacatggtatcaagcaagacggccagctccatgtagaataactcataaactttctcattggatttgattttgggtgactggcgtagagccaggcagtaggctctaactgtgtccataatattggccaggattcaagttggagttctacaatgagattagttttcctcaaattaaccccaaatctacttccttgtgacatctacattttggtccttgttttgaattccatggctatcctaaatatgcctaacgtaaggatttgcctctttaattgtcccagagcatttttatgatcttcttaatcttctccaggttaaacactcccattccttcatcattttttcattaaatatattcatagtttctcacaagcttttctgttattcactccatcatttattacttccccaatgaccacaataaactgactttctattaaaagtttaatgtcctttttcctccaggagtggaggctccatgagagtgaggaatgtggttattgtgtttatttagtacatggcttgagaggtaatacaagcacttagttttaggaactagcatgctcctgcacatggtaggcatttactatttatttgtagagggagtggttttacaggattatttttactgtgttgttattgcaagttttgaatttgcatccattttaactgtaaattgctaagcattatgaccatccggtagccaacttttcttccttccttccttccattcttcctttttcctttcctttccttccatccttccttcctttcttccctctttccttcaattcaacaaacatttactgattgcctattctttgctcaatctaatgacacgatgttgaatgagactctgtccctactgtccaggagtagtagaaagacagattcataaacaattataataaggaaaaatacttactctaatgaaggaactaggaaatgctttacaaaaaaacaaaaaacaaaaaacaaaaacaagacaaaaaaaaagttactgtcggcctccataacactccttgttgcttcctttgacattcgccatccttgcagttcttcacatggcagtaatgtcttcagcaactcaagaaaataagtcatagcagatcacctggctttgggcattgttgactagagattaggaattaatacatgctaagcaagcacttttaacttaaaaaaagtttcaaactgaccattagatgaaagataagttaaataactggtttcaataagtgatacatataaaataagacatacagaaagaacaagatttcgaagctatgggatattatattcaagttgtcattttgtctatcaaggactttaatgcattcctcatggggttaactttactgtagatcttcttttccagaataagatacttatttctagctcagacggatttctcttgtttatattagctggctatttctgcttttctgaggcttgagacttcatagtataacagtgctgatggctttaagcttttaaatctttaatcaccctaattcctgtacttggggtcatattacttaagtaggcgccactattctcaggaatagaactgctaaaataaaaatatatctgtattttttcttcccctgtggtttacctaagacaaacccgagagaacatggaactggaaagcacaaacttcttatttccttcaaaattattctttgcctgatcacaaaagacctcatgtgttatggttctagtagcgtggtttgtcatctctcttccactttttttcttagtaaatagaaaattcattagatcttgtttagtcttgttcctttgtatcagacagtaataaggatggccataaaaacaacaggggctaacattttggagcacgtattatgtgagaatttgcggactaagtcccatacatgcattatctgatttaatccccatattattgtatgtgcatagactctaatacaaaggttgtcagtaacacagtttcctgtgctctgccctttgagagtttaattcaagagatctagaggaggtgcagagctatgcatttttggatggttttaagaaaaggagtagctgcagtttttaatacatatgctggaacattgtaatgaaggtgttgctaagactggactttggaaaataatggtttgtatgcaccataatagataaatctctgagatggtgtattagtccattttcacactgctgataaagacatacccgagactgggtaatttatacagcagaaagggtttaaggaacttagagttccatgtggctggggaggccttacaatcatggcagaagccaaggaggaacaagtcacattttatgtggatggtggcaggcaaagagagagcttgagcagggaaagtcccccttatagaaccatcagatttcgtgagacttatttactatcatgagaacagcatgggaaagacctgctcccatgattcaaccacctcccactgggtccctcccacaacacatgggacttgtgggagatacagttcaagaggacatttgggtggggacacagccaaaccgtatcattccacccctcacccctcccaaacttcatcctcacatttcaaaaccagccatgccttccctcacagtcttaacttatttcggcattaactcaaaagttcacagtccaaagtctcatctgagacaaggcaagtcccttctgcctatgagcctgtaaaatcaaaagcaagttagttacttcctagatacaatgaggttgtaggcattgggtaaatacagccattctaaatggtagtaattggccaaaacataggggctacaggccccatgtaagtccaaaatacagcagggcagtcaaatcttaaagctccaaaatgatctcctttgaatccatgtctcacatcgaggtcacactgatgcaagaggtgggttcccatggtcttgggcagctccacctctgtgcctttgcagggtatggtctccctcctggcttctttcacgggctggcattgagtgtctatggcttttccaggcgcatggtgcaaggtgtcagtggctctaccattctggggactgggggatgattgccatcttctcacagattcactaagcagtgccccagcagagactctgtgtgggggctctaatcctacatttccttccacactgcattagcagaggttttccatgagggtcccacccttacagcaaacttctgcctgaacatccaggcatttctatacatcttctgaaatctagatgaggttcccaaacctcagttcttgatgtctgtgcaactgcaggctcaacatcacatggaagctgctaagacttgggacttgcaccctctgaagccacagcccgagctataccttggcccattttagctgcagttggaacagctgggttgcagggcaccaaatccctaggctgcacacagcagggggccccttggccaagcctaggaaaccatcttgtccacctaggccagtgatgggaggggctgtgatgggacgggctgccatgaagacctctgacatgccctggagacatttcccccattgtcttggggattaacatttggctcctagttacttatgtaaatttctgcagccagcttgaatttctcctcagagaatgagattttcttttctattgcattgtcaggctacacattttctgaacttttatgctctgtttcccttataaaactgaatgcctttaacagcacccaagtcacctcttgaatgttttgctgcttagaaatttcttcctccagataacctaaatcatctctctcaagttcaaagttccacaaatctctagggcatgggcaaaatgccaccagtctctttgctaaaatgtaccaagtatcaccttctccagttccccacaagttcttcatttccatctgataacaccttggtcaggatttcattgtccatatcattatcagcattttgttcaaagccattcaacaagtctctagggagttccaaacttccccacattttcttgtcttcttctgacccctctgaactgttccaacctctgtttgttacctagttccaaattcacttccacattttcaggtatcttttcagcagtcccccattctcctggtcccaatttactgtattagtccatttttacactgctgagacatgtccgagactgagtaatttatacaggaaaaagggtttaatgaacttacagttccatgtggctgaggaggcctctcaatcatggcagaagccaaggaggaggaagtcacaccttatgtggatggcagcaggcaaagagagagcttgtgcagggaaacgcccccttacagatgagatctcgtgagactttttcactatcatgagaacagtctgggaaagacctgcccccgtgattcaacaacctcccaccaggtccctcccaaacatgagaattgtgggagagacaattcaagatgagatttgggtggggacacagccaaactatatcagatggaaatcacatcatcagtggggtgaatggggtgatggagggaaatcagggaaggctcactggaagaggtgtggtataggaatttgaaacagaactctggagccagggagctccagctctcgtgccagctctgccacttgctagttgtgccacttagcatttctgtgcctcagttccccctctgtattaggctgttcttgcatggctaccaagaaacaccagaggctggataatttttaacgaaaaaagatttaattggctcatggttctgcagactttacaggaatcatggtgatggcaactgctcggcttctggggaggcctcaggaaggttttattaatggcagaaggcaaagcgaggaagaggcacatcatatggtgaaatgaccagatcttaggagaactcactcgctatcacaaagatagcaccaagccatgagggatccgcccccatgtcccaaacacctcccaccagaccccacctccagtattaggaattacaattagacataaaatttgggtaaggacaaatatctaaactatatcaccatctataaaatgagaatagcaatagtattttatgcatatagtcactgaaataattaaatagaccaatgcctgtaatttgcttagaacacttccaggaacattgttaagagtggtttaatattttctctctttatatttttgtggttggaggatgtaatccttgaactgaggcttacagggtgaggaagagtcaacctagtgaaggaccagatgtggcaatggcaggtggcctctgcggcagagcagatatcatgagcaacagcacagatatgagaagcagcctcgtgtggcttgagtgtgaagtacgggaagtgaggttagagaagtaggtagaggtcaggttgtgaaggtccttgagttttatactgtgaattttaaagtgatggagaaccattcccaggagttacagagggtggtgttttagttgtttccagggtagaaatgtggaaaatggatttgggaaaaataagaccagagacagggtgacaagttaagcagacctgcaggagtccaggtgacagatggggaagagatagaacaaggatagaaaggatagccaagaaacatttaggagataaaataggcacgtcctgattttaaagggagaggttaggaagaagagagggacgacgagccaggtttctgttttggaattaggtgaatggtgacaccacagagataaagcagaatggagtttttacagatttagtgagttcagttttgggctgtggagtttgtgacacctgtggggtgtccccagagggatgcctactggcagttggacattatggatgtgaagtttagtgactggttttgtctgaagcttgaaacacgtgatctagtagaaacaaaagctctgggtaaactgaaaagaacactacaaacataaagcattcagatcagtgttattcggttcttgtagtcttcagcattaattagtttgttagaatacaaagaactccaatgaaatttacctaaaaaggaagaatgtactcttcccctggctcattagaaggatttctgaagagaaaattctgtgtgcaatgacatgcatttaaattccaggcttccaaagaaaatttcaagacaggctatccttattcttggttaattagaacataagtagataaaccagcagaagagacctcctttgagtaggctttgctgtttttttgggtttcttggaggattacttatacctagggctttgttatacgaagatatttttatagatttactgaacgttagagttagaggcaacctgatcttacatgttagaaagaagaaatccctcaaggttgaatgatttactccaggtttcatcttcaacacatggcagagccaggccctagcaaaggtccacaggactagagcaatgggcttcttcagtgttctatgctgattcttattctgcagcattaacaaatatgtcccccacctcctaactctttctttttcctctttatcttgctaaagggaacataaacataagaataaatatagcactatgagggtggccatgttgtctgggaaaactttcctcaccaggacatagcctattactctcaaactgtctaataaggtttagttggaaaattctgttgggattaaactgtttccatatttaaaagataagtattgcatctctatacacaatatttttttttctccaatgtatattagttatactggtggtgagagtagcacagcagttgtagtagcagcagccacagcagtggtaggagtagctacagtagaaaggcaggggtggaggtagtaatgatgatggtgatggtgatgatgatatgtatttagtgagtgcttagagcagtggtctccaacctttttggcaccaggaacaggttttgtggaagacaatttttccaagacctggggtaggtgggggatatggttttgggatgattcaagcacattacatttattgtgcactttatgtctattattattacattataatgtataatgaataattattaactcaccataatgtggaatcagtgggaggcctgagcttgctttcctgcaactagacagtcccatctgcgggtgatgggagacagtgacagatcatcaggcattagattctcatacggattgcacaatctagatctcacacctatgcagttcacaatagagttcttgctcctatgagaatttaacaccaccactgatctgacaggaggtggagctcagggcttaatgcgagtgacagggagctgctgtaaatacagatgaaaattcacttgctcacctgctgcttacctccctcctactgtgtggtccagttcctgataggctgtggactggtactggtccgtggtctggggattgggaacccctgccttagaggctgtatagaagcttaacggaagactctgatgctcaagttcaaattcctgaggttgtatcccagtgtaactatttcctgctctatgaccttgggcaaatattaaacttcttgaagtctcaatttcctcatcaataaaaagaaggaaaacaaaaatgcctacagcaaagggatatgatgacactaaaatgaaaaagaaaaaagtatataaggcttctgacaaaacttgtaaccctgactgtgagagagatttgattatttacctccattttacatattaggaaacagagactcagggagatgaaataatctacaagtctattttatggcagagctgaaattcatatcaggtctatctgactcttgagcttgtctcataaccaccatatacattttctttggataaattgcttcaattttgaatcctgaaaattacttcttgagtcttgaaaaacaagctatttaggtcatttttgtgtttgccattccaggatagttgtcaacatacagaatgttgcatttctgaattctctgaaattgttgcaacaagatgtttctgttgtaaagagtagtcctttggatcatggatgattaaccttccccatgaacctggcaggtgacaaaagtgtacctttggttttcaagactgaggaccagacaaagtagaatcacagaagacagagccagggccaatagacactgttagtggaaaagtgtctgaaactataacttttgcctatttcttttgtatacaatattgcactgagactggccagaggtggtgcctactttgtacaggtggcatagtgattgcctgaccttctgtatagatatactattggcaccaggggtaaaataagctgccttttgcctttccattgaagcctgtgacctctgagattctgactcttactcctaggctaatagactatttgtgaccttcaatgagtttccttcccctttgttccttttctataagctgattcagaaaccaacttgtagtttgtgataagagtattgaaaacctaactatgatattacattcaaccccacaaagaaattttacttcagtggaattataatgaattgctttcattttacaccattttaaaccccaatgactttaacaagagggctgttgaaagtaaatgccaccttattacatactgtgaagaagcagcaattaagatgttgtctaagttagtcaactttctaacttagaatttcccaagtgtctcaagtgggtagaaaaatgaagccaatgtcaaatgtcaacactactggtgatggaccaagaacgactatcttttcttctttccctttttttttttttttttggacaaggttttgctctgtcacccaggctagagtacagtggtacaatcttggctcactgcagctttgaccttccaggctcaggccatcctccttcctcagcctccctactggctgggactacaggcacatgccaccatgcctagctaagttttgcatttttcgcagagatggggtttcaccatgtttcccaggctggtcttgaactcctgggctcaagcaatcctgctgcctcagtctctcaaagtgctgggattacaggcattagcctctgtgcctggctgatccactatctttcataggaaaaagaaatccatcccaatcatctaggaaaaatctccatcagcagaatcaagtgagcatcacagaaatgtggtttttgttgggttgttccactgttatttaagcattcttggtgaaagttgaatggaaaggcaaagacctgaacccagtgtttttacttgtggtgtagtggtctttgaagatgagagtctgataaaagagaattctaaagtagcccacacagaagtcaacaagccataaggggtttttccattgttcctacttctttttttttttgaatgtttgtttgtttgtttgttttaaattatactttaagttttagggtacatgtgcacattgtgcaggttagttacatatgtatacatgtgccatgctggtgcgctgcacccactaactcatcatctagcattaggtatatctcccaatgctatccctcccccctccccccaccccccaccagtccccagagtgtgatattccccttcctgtgtccatgcgatctcatcgttcaattcccacctacgagtgagaatatgcggtgtttggttttttgttcttgtgatagtttactgagaatgatgctttccaatttcatccatgtccctacaaaggacatgaactcatcattttttatggctgtatagtattccatggtgtatatgtgccacattatcttaatccagtctatcattgttggacatttgggttggttccaagtctttgctattgtgaataatgccgcaataaacatacatgttcatgtgtctttatagcagcatgatttatagtcctttgggtatatacccagtaatgggatggctgggtcaaatggtatttccagttctagatccccgaggaatcgccacactgacttccacaatggttgaactagtttacaatcccaccaacagtgtaaaagtgttcctatttctccacatcctctccagcacctgttgtttcctgactttttaatgattgccattctcactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctcgatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaataaggaatcctttccccattgcttgtttttctcaggtttgtcaaagatcagatagttgtagatatgtggcgttatttctgagggctctgttctgttccattgatctatatctctattttggtaccagtaccatgctgttttggttactgtagcctagtagtatagtttgaagtcaggtagtgtgatgcctccagctttgttcttttggcttaggatagacttggcgatgcgggctcttttttggttccatatgaactttaaagtagtttttttccaattctgtgaagaaaggcattggtagcttgatggggatggcattgaatctgtaaattaccttgggcagtatggacactttcacgatattgattcttcctacccatgagcatggaatcttcttccatttgtttgtatcctcttttatttcattgagcagtggtttgtagttctccttgaagaggtccttcacatcccttgtaagctggattcctaggtattttattctctttgaagcaattgtgaatgggagttcactcatgatttggctctctgtttgtctgttgttggtgtataagaatgcttgtgatttttgtacattgattttgtatcctgagactctgctgaagttccttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtgagagaggtcatccctgtcttgtgccagttttcaaagggaatgcttccaatttttgcccattcagtatgatattggctgtgggtttgtcatagatagctcttattatcttgagatacgtcccatcaatacctaatttattgagagtttttagcatgaagggttgttgaattttgtcagaggccttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggacattggtctaaaattctctttttttgttgtgtctctgcctggctttggtatcagaatgatgctgtcctcataaaatgagttagggaggattccctctttttctattgattggaatagtttcagaaggaatggtagcagctcctccttgtacctctggtagaattcggctgtgaatccatctggtcctgtactctttttggctggtaagctattgattgttgccacaatttcagagcctgttattggtctattcagagattcaacttcttcctggtttagtcttggtagagggtatgtgtccaggaatttatccacttcttctagattttctagtttatctgcatagaggtgtttgtagtattctctgatggtagtttgtatttctgtgggattggtggtgatatcccctttatcattttttattgccgtctatttgattcttctctctttttctcattaatagtcttgctagtagtctatcaatttagttgatcctttcaaaaaaccagctcctggattcattgattttttgaagggttttttgtgtctctatttccttcagttctgctctgattttagttagttcttgccttctgctagcttttgaatgtgttttctcttgcttttctagttcttttaattgtgatgttagggtgtcaattttggatctttcctgctttctcttatgggcatttaatgctataaatttccctctacacactgctttgaatgcgtcccagagattctggtatgttgtgtctttgttctcgttggtttcaaagaacatctttatttctgccttcatttcgttatgtacctagtagtcattcaggagcaggttgttcagtttccatgtagttgagcggttttgagtgagattcttaatcctgagttctagtttgattgcactgtggtctgagagacagtttgttataacttgtgttcttttacatttgctgaggagagctttacttccaagtatgtggtcaattttggaataggtgtggtgtggtgctgaaaaaaatgtatattctgttgatttggggtggagagctctgtagatgtctattaggtcggcttggtgcagagctgagttcaattcctgggtatccttgttgactttctgtcccgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttaccagagactaggattgcaacccctgcctttttttattttccatttgcttggtagatcttcctccatccttttattttgagcctatgtgtgtctctgcacgtgagatggatttcctgaatacagcagactgatgggtcttgactcttgatccaattttccagtctgtgtcttttaattggagcatttagtccatttacatttcaagttaatattgttatgtgtgaatttgatcctgtcattatgaggttagctggttattttgctcgttagttgatgcagtttcttcctagtctcgatggtctttacattttggcatgattttgcaatggctggtaccggttgttcctgtccatgtttagcgcttccttcaggagctcttttagggcaggcctggtggtgacaaaatctctcagcatttgcttgtctgtaaagtattttatttctcctttgcttatgaagcatagtttggctggatatgaaattctgggttgaaaattcttttctttaagaatgttgaatattggcccccactctcttctggcttgtagggtttctgccgagagatctgctgttagtctgatggcttccctttgagggtaacctgacctttctctctggctgcccttaacattttttccttcatttcaactttggtgaatctgacaattatgtgtcttggagttggtcttctcgaggagtacctttgtggtgttctctatatttcctgaatctgaacgttggcctaccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttcttgcttcatttcattcatttcatcttccatcactgataccctttcttccagttgatcgcatcggctcctggggcttctgcattcttcacgtagttctcgagccttggttttcatctccatcagctcctttaagcacttctttgtattggttattgtagttatacattcttctaaatttttttcgaagttttcaacttctttgcctttggtttgaatgtcctcccatagctcagagtaatttgatcgtctgaagccttcttctctcagctcgtcaaagtcattctccatccagctttgttccgttgctggtgaggacctgcgttcctttggaggaggagaggcgctctgctttttagagtttccagtttttctgttctgtttgttccccatctttgtggttttatctagttttggtctttgatgatggtgatgtacagatgggtttttggtgtggatgtcctttctgtttgttagttttccttctaacagacaggaccctcagctgcaggtctgttggaataccctgccgtgtaaggtgtcaatgtgcccctgctgaggggtgcctcccagttaggctgctcgggggtcaggggtcagggacccatttgaggaggcagtctgccccttctcagatctccagctgcgtgctgggagaaccactgctctcgtcaaagctgtcagacagggacatttaagtctgcagaggttactgctgtctttttgtttgtctttgccctgcccctagaggtggagcctacagaggcaggcaggcctccttgagctgtggtgggctccacccagttcgagcttcctggctgctttgtttacctaatcaagcctgggcaatggcgggcgcccctctcccagcctcgctgccaccttgtagtttgatctcagactgctgtgctagcaatcagtgagactccatgggcgtaggaccctctgagccaggtgcaggatataatctcgtggtgcgctgttttttaagcccattggaaaagcgcagtactcgggtgggagtgacccaattttccagttgccgtccgtcacccctttctttgacttggaaagggaactccctgaccccttgcgcttcccaagtgaggcagtgcctcaccctgcttcggctcgcgcatggtgtgcgcacccactgagctgcgcccactgtctggcactccctagtgagatgaacccggtacctcagatggaaatgcagaaatcaccatcttgtgcgtcgctcacgctgggagctgtagaccggagctgttcctattcggccatcttggctcctcccccctgttcctacttcctaattaatttattcctcatttttttcctgaagcaatttatagaaaccttaaatataagaggcacatcaacatagggttataagtctgaattttgctgtctgatagacatgaggtcaggtcctaaaatataacattttctagctttgtgacatcaaacaaattattaatctctcaaagtcttgtttccacaactgtaaaatggacaaatgcatagtacttaaattattttggttgtttgagcactgaaagagtttaagttagtaccaaagcaattgctatgctgttgctgttgatcatgatgataacgatgatgatgatgagtttagttttatattgtattataatactttgtttatgtctgcctgtcacactatatagtgagggccttgaagggaggaatgaattgtatttatgttgtgtctttcagagactgacacagtttcagctactttggaggcatctaaaaatgtaagactaaatggaaggaagtggagcttcggagctatcgagtcctggttgtcattactaattatgctatttgacattgagaaagtcattgccttcttggtttatccacttctccatatacaaggaggaagtattctacctaccctttagggatgctataagaatgcatttaacatttaattgcaaattgtaccttaatttgtgaaggattaatattaaatattaatgaagatcacagccttccatttcactcctttctttgtagttgcagagtactcaccagcataatggagcccgaaaggaaaaatgtgaaggctaggtcttatgtcatgcacatatcaaatgagagagagcttctaaaatcagagaagggctctatccagaaacaaaatacattctgggcagtaaggaaattaattgaggctatcatctgcaccaaaccttcagccccaacctattaacttctaagtagttaaatattttaggtgataatcacttttgcctttgtttgaattatctgaattttaattgcctgttttctatagattttatgtgaaaaacatttcaagtaaaataatacattaaaaggacgagggaagaactccacaaagtgatcattatgtgtgaacactgagattatagatgatttctttgttcttccttattccaaacttggtttaatttagctcatttagtggcatggaacagagtcattcagaccagcacaagtgcatggatgtttatggtcactaggcctatgggctctcttgacaacttgtgaacaggcattctgacactattgtggctcatgggaaatggagttaaatgggaagcatcactgcagatctgagcagtagaagatcttgtatgctctggcaattcccagcttcagctcctttcttggtcttgacttcttctggcatcttttcttgtttctggtctgttaccaactagctgacattcagccttgatattttttttttctctccctcagcttcggatttttcatgatcatgcttcttcataagtgcagtacattctccacatatcttgttagtgtccctcccgacctgtatattaccacaggaacctcttttttctttgcatgcattcaaattcagacatcactgcaaagactcttctttccatatttccctatttaaatgtcagagagtgaaaatcttaatggctcagctcattcctctgtaagcaatgctattcatgccagtataccacatgggctcctggctggctaattggctgggtaccctcagttctggaggtgaccaaacacgtgatgtgatgggtatactacatggcggtctagggccatccctaagtaaggactatgagctgggaaatttccctgatggaggaatataggtgtggcaggcacctctttagtggagttgttatgttatttttatatgtgtaaaatatatatttagcactggaaatagattattagaagaattttgttcacatccagcttagaaaagataagaatttctctttatgtatgtctttgttgtatcagtagctcttttctgccacgtttttgtgctgctgtgcctttcttatattataccttgtgcttggaagatcagtccaaaaaatttctctgccaggatgcttccaaaattcgggtttcacctctaactcttagtcttgtttcctttaaaaaattagtccccggctggacatggtggctcacgcctgtaatcgcagtagtttaggaggctgaggcgggtggatcacctgaggtcaggagtttgagaccagcctggctaacatggtgaaaccccatctctactaaaacatacaaaattagctgggcgcggtggcaggcggctgtgatcccagctacttgggaggctcaggcaggagaatcgcttgaagccgggaggcggaggttgcagcgagccgagatagcgccattgcactccagcctgggagacagagcaagactccgtctaaaaaaaaaaaaaaaaccaaaaaaaccaaataacaaaaagtagcccccatacttcagtgggaatcggctgccttctctcctatactctttactctttagttctttgtacttttgttgcagcactttgaaatatctgtccttatgttagagtcactgctgtatgtactttcctccccattgtaatgtgaactccaggtcataaaaattttatctcgttatccatgcatcagtagcacactataaacatgtgtgttcaaatgaaacactttggggttacaatatagaaatgataaaatggactcacaataggatttctcacctactgtgagtcagggattttctcacttaaccctttttataattcctgagagtaaggcattgctatctttattttatagatagtggataataagtctaaagtcagtaaccataaagggattctgtggttaaagaaatctggagacattcaattaaagaaagctaacagttttctctccaacaggacttatcaaggccttaattgtgaaacactcattagaaacccctaaacatacagagtatgcaacatttcctaacttatttgattatgattacatgttttgaggaataacttgcagggttagtgcacaaaggagcacattttgagcatgccaaggtgaataataatgcctgaattagagtgggcatttcagtgattctcctggaggttaaatgtcactgtaatatcaaacatgacagagtttcttggtacattgtcaaatatggctcttgatggttatcatcactcctgatcttcataagagactgaagatcaacctgctgccttccatagagctttgaagtggcttttatttgtttttgatttttatccactccaaagagtatatctgcgtattccaataatccaagttcctgtcacatatttagaaatcactggaactacctagccactcagagagtagggaaaggatattctttagctgagtgggttttcaatcaactccctcaaagtatactcccttagtattcttctgaagcatttccccaaatctctttccacagttcatgtagtgaatctgcaacacagtatccagccatgcctgaacaggtgtgcccaacatggaaggttctagccacaggtctggatctttattgcagaagatgaacactcagtaattttggtgttttagaaaatcaacatctgatgcttgatgagcccacgattctcccctctgccctgaaggaattgtctctgtttacatgaggtacagcccatttgtaaatattaatactaaaatgggcagttattaaccaagcatctggaagtggagaattacctgatgttctgatgtgagtagtggtctatgaggtaaaccacctaaggtcacttcctttcctttctcaaagtagactagggtcacagacacttccagcatattttccaagttattgagggcatttggtcattgagcttatccaggaaagtgtctaaccagggtcaggtgtcagtaactgtgtagaatacagggtatctttagggcttcttggagatgcaagtgaatatctgggcagtcctttacaatttgcagaagttctcttctttctctttgtcctctgatttcagcagcatgtgtattttgtatgtctcaattgtctgagttttggaagcatctctgattgttgcatgttaaaacagcattcttactttgcattttcacttattcttataaacttcttatagaactgtataaaaaacattttgactataatttttccttctaattttaaaatccatgtctgaattactgggatattttaaaagtatctttattctataatgagaatgaggggaaaggaagatgaaataccaaaacttacctttaatgtagtctaaatggtgatagcagcttttgccaataataatgattttgaaattgtcagacttgtggccacacatcctattgtgatataaacctattttcccagacagtggactagtagagaggcattctttatgctaacagataacaaaagactttaggtagtgttctcttaaatcatttacaaaaagaatctttccccttgatcaggaccattgaggttaacataggatgttagagcattattttccttgcaacatcgttttttcaaaatgaaaagggtcttcaacaagacaccctgcaaatcccaagacaataattacattcttgggactggaaatcttgcatgtttgcagacattttagagtttggcatttgtggctttttgcacactatgaaatatttatgcattgttcaaataaccctgcttagttaccattggatacctactgttgtacaggaattgcatttagaaaggaatagaatctaatttataaaatctataaagctctcatactcagctacttcagtagaaatccttttgagacaatagttgaaaatgctgggaaatagatgttaatttggtttgggaagttttttgttggtggtggtagtgaaagaagataattactatcaatattttcactctcagttagaggacatgaggttgccaatgaaatttgactatccataccagaaatttaaaaaataataattaatgttaatacaagtaatacattttattaacacaaaaatatataaaaatagattatttataactaccacctacagaaaacattttagaaaatgtcctcaggatttttgtctttcttccctcccttccttcctccctccctccctccctccttccctccctccttccctccctccctccttccgtccttccttccttccttccattcttccttcttccttccctctctccctcccacccttctttcctttcttccctttgtccatatatccatccatccttgtatttaaaacatagcattatattaaacattaacttttcataaccaactttttaaatgaagcaacatactttgaatgttttccatgccaataaatatacctctacttcatgagaattttatttcattttgtgaatgtcccctgaattatatatacgatctcttactattggaatttttatatttaaaaaatttttttctactataggcatttctgtataaacattatttacttatttatttattcattcaataaacatttattgagctgatactgtgtgccaggttctgggactacaaccatgttagacacagctcatgtttttgtctttcggtactactatgataaataaataaaacaagatcatttacatttagtttgaagtaacaacatttatttttgctgagacagtctttatcatcagtgacaaggttaacacagctggctattacttcccaaggctattaaaatattttacataaatcataccataatgtggacttggaaataataatatgtactcacaaagcatccatagcctatattaatttagctgaaaaataatatagcaatcatactgtcagactgcctccacagccacagtaaattggtgctatcaggctcagaatttatcttttcatagattttggtttttttgatcatttgtggttttgacacatatagaggtttccgctcagagcaaccaggaaggtggaaacagtgtgacatcacgtataaagcactggctgagagccagggattttcaatatgaaaccaagttcaactaattattagctacttgacctttggaggtcatcaaatattccaaagcttcagtttcctgctctgaaaatgagagcacagtgctggataatttcttagtttctgtcagtctagcaattttgaacctgtgcgtttttcattgtttttactggaagttaacagtgaaatggtcaaggaccctgttatgaatattgattccatctgtcaaagccaagctgagaggtagggatggcaaaacaacaaatacaatgagagctctgagccaaggagtgatttgatatataaaattctaaaagattatcttcactatatgtgtttgaatacactgtagaaagtcaaatgcagaagtggaaagaccagctggaaggctattactgttgacaaggtgagagattgcagcagtctcactggagatggtgagaaacggccacattctggctctatgtaatggtagagctgatcggacatgctggtaactaggatgtagggggagagggaaggagatgttcaatataactctacggtttttggcccaatcaactggttatatggtggctgccattcactgagtggagtgtcctgaggttttcatgaggatgagtgggggaggagagtcaatattttggttttgcacgtgctatgcttgaggcacctattagacatacaactggaaatgtttgaatatgaagctggatatgtgagcctgaaactcaagagaaagttcagggctagcaatttaaatttgggagttctcagtattggctaagtgatcgtaaggcaattaatcttgatatgcctgaatttacttatttgtaaaattgaggtaatactttttgtgaagtttaaatgatatattatgaattttataaaattttcagcacactggctgttatgtagcaagtagattataaacattagctgttcctcttcattacaatgatggaagtataggtggacagattggtgattaattagttaataaacatgaacactctttaaatctaattcagaggtttggaccatcttgggaaagacagaaaagaagtttatctggtttcagtgtagggtataagagagaaggcaaataccagacatttatttatattagtagttggaggcatgcgggttattaattacaccttccagggaaacccaagccatgaattccaggggaatattatcatggttgactctgccaactccaatctttgtggttgaaatgtggtcctgacccctcttgcctagatggaaatgttaactagaaaagcctgtgtagttcctgaggcactcagagagaatcctttttaataattcagccatctgtatttagctggtccctcaatgtctgggctaggtcttgttaggaataaaggataaaatattaaagggacaaatgtaaacaacactggcttgaattacaatttctagtttaaaaacatgttcatgactcacagagctattatacgtgtgatctctgagaatgaaattggctggctgacctcctaagattccctcttaaacacgaagtgaatatttcactataatgaccaagactttgcagttgaggttagcagcttgagcccttctactcactaagaattccttcattcgttcaatcaccaaagatgtgaagagcaactaatgttagccaggcatccaaatagctgagaatttcagtgtttttggagttgtgacagctgagttgtcattggttaataacccaagagtcttctctccaacacataaaacaaacaaatccctgcaagatatgtttctgtcttttagaatcaaacatttattctgagatgcttacagattcacgtgcacttgtacaaaataatatagcgagatcacgtgtaccctttactcagtttcctctaatggtaccatcctgtaaaattgtagtataatatcatgaccaggacactaacaattcatttttacattaagatttggtatcattagaattataaatgtcagattggaaaccacaactcaaaaccacaagacatgaaaagacatcttagccagtgctgttttttctgctttgtaccccatgttgttcccctccacctgtgactctgtgggtctggataggaattctgcatgtctggtggtgttttgtgcctctcatgggtgacactcagctcatcagtgattccttgttcaatgttggctgtcctttgtgactataacctcagagggcaaaaattatacctgctatttactactgtttttatggaatctggcaaagtgtctggcactcaaagaggctggatgccttttacttgggtgagagaatcaattaatctgcccagctgagagaagtgcatttctgaaagacgggtcagagacaaccaggaagttagtggtaatgctgcttaaaatcaatgttagtaagacttttgcttctttgaatccaaatctgttatcttcagaaagattctcagctaacaaaacaaccagaatatttatgtgttcagacacatgggaaaaataatattttttaaaacaatccaatctgagctaagtattaggagagcactgaaatgtcttgaaatcaagtctgaagaaataatctgcttcagaatagctttcttgatgaggaacactttttcgttgtctaatgttgttctaatcagctggacaatcttagctgaaagatttaccctataaaatgacaatataagttagtatttccctaaacctttcttttcatcaccaaggacacctacagacttctctctggggataatggaacattgaaaattgggcattttaaataggttggcagttatctgaaacaagtagtctaataaagaagtatgcccttatggctagccctgagaacaaatggtatatcttaaagttagtatgtttattgttttttccattgaaaagtttggctttttggagcacaaaatagctggctgactttctatccattctcacttctccagtgctttaaatcataatatttaacttaattatcagtatctgacttgagaccttccaagattcctcagtctgccaggtgctttgtttcttggcactgaaaagtcatttggtataaaataatgagcaaagcaaacatggtatctgactttatagagcttattttctaatataaggaacagatcaaaatcaagcaagcagatcaatgaattatatactcattaattttgataaaccactacaaatgaatgaatgaatgagcaaactgaggatgaaaaaagcagccctgagaggcaggagccagcctcacacatgcagtggggccatgttcacctggctaacccaaacgatttcacagaacatcaatatcacacaagaccatgctgagatgctgggatcgagacaagaactctaatcatttaagaacacagacaaaagcataaacattttccaggccacaaaaaatgaccaagtatctcctataacagtttgaatgactgctggtttccttaacagttttcaccttgtcctgtgttttcatctcctaagtaagaattattaagatacccagtcacagaattatcccagcttctagacaacatccagttcaaagcaatgtcccatttcctggaattatctcccaaatcacaaaacataagcccaaattctgtaataagccctctctaatacccaactcacctcagtcccaatggcatcagctctccctcattgcagcaagtgaataaacccaacattgttcaaattaaggtgcatttttattggtctttggcttgagagcattaatgaatgaaacacacaccttttttttttctgatgcctaaagactttatccctgattgaactgctgattctagatttgggataaaacctgacaaaatgtaaatatacctgaagaggaaaatagctcagtcaacagtgacttgttatagagaaaaagtcagaaagatctagaagcctaagtggtatttagagaaaaaggttctgagaaggtggaggtcagcacatattcttacatgctttgggtgaaggacgacttcttgggaagaagctatgaagaacagataccagtgtggggagagatttcaacttttcaagaagagttttagaccagtgataaatggacaagaaaataggaaggaaagtgagtcatgttctgccagtaaattcctccttccatctcaggtaaatctttcatggggcttattaagcagttttcattaaagagtttataggtacattagcaggcaaaagaacacttctttccaacaaacagctctcagaagtcataaacagaaactcctaatatctggacacccaccagaatagcaatcgcactccccaaatgtaccaaaataaaatcagcagcccccatgtgcatacagaagaaggcaggataaatcataatggctgagttagtatccctttaacccagagaccaagatttacacactacaactccgttagctttattgtctctgctgaacaaggctggctgggaaaaacttaattttaagtattttattacctgctagttttaaacagtctctttcaggttagctcagtttcttttggatacataatcagtcagattaataaatgaaattcactttatgtatgtttatttcctctcgaaagtcttccctgtccttcctcaaaatcctgggtggcattaaacaaagaaaaaagctttcgtgtactctcagtgttggaggaaagaatgctggagtgagctgtagctggactgttacctgggctcttcttggccttcattgagtttaattcttgtccggcctggtcactgagcctctttctgtatatgtctctcaaattcacagctgatgaatgtgttcttcccacctaggctttccttcctacttcctctttcctgtcccataacttggtctaatttcactacctttgggtctgagccatgatgatgttaaactagtttccatcccccttatttcagctctgaggaagaccttaaaaacttccctagcacacccatggcaggcccttcttggttcttaaatttcaactactatttattgtgcctaagagatcccagaaacttttagatctttcttatattatcccaatcatcccaatctttgcagcactgtggtgggatctcgggaggtaggtcagtctaatgggtcactttctgtctgactatgtgatgtggccatttgtattcttctgcagctgctccaggtcagaaggttgcatattgctagttgcattcccccagagctataggtggaaagctgcttatggcatcccatatcaatatatcttgtgtttttattactccccctgaggattggctaccaaagttggataaaggttgatgaaaaataagaatccaagtttcttatcacctggaagcattctctgtttcccccttaaatgagaacttacagtatattctatcctgagtttcctctacccatggcatatagaaaaacctcatagatctagtcaccaggcctgtctcttgatatggaaaggaagtttttgcaatttacatatatttttctctttttgacaatgcctgactgtcaaaactattttcatgttatggactcaaaataaatctaatttgacagtcaacatgtataaggattttgttattgtagatgatgcctgttctttctctcaggtgctgaaacccattagagtggggggtggatgcctaggatactgtgatttaagatgaatgaaaaatataaaaaatataccagtttaacatgttcaaaaatatgatacctaaaaaaactctaattccatccatcatgatttccaactttggtgggtttgtgggtgttgttattcttcatcttctctgagccaaagaatccttctctggcatcctaagtaatctgtttatttattgactttgttacttactgtctcacttcctcaattagaagatgaggtccacaggcagggctcttagtctattatattcccggaggtatctccagttcctggaacacagtagggacttgtaactatctgttaaatgaaggaataaaagaaacagactttcctacgtgcattttatgacaaatattaagaaagtcagattttgtttgtatctgagaaagtgaattgttaataatatttgctgaagaatgcttagaaagtatcagttaggtgctgaggttacagtagggaacagacatactgagccagttctcatggaaggatagaaggagagagatcaatttttctaatcctagctctggcaagttatttaacccccatgagcctcagtattctcaagtgtaaaatagagatatggccacctaccctacagtgttgtacttatatcacaagtactgagtggatgttagtgttcttgctgcttcactatcacaggtgttaacctatagggtgatgtgaaaagtcagagaagagaagggagaaaaaagaaattgaacacaaacttggtcctctatcataactggaagttgctttagctcctgttggtcatttttctctgattaacaaggagtcatcttgtagaataactgttggtagttccagagaattactcctatggcagactgtacaaggtcacccatcatggaaatggcctgtgaccctctcagaggcccttaagtggcttggtttcaggcaggtagcattctggttctttgtcttccagccagagagatctgattggctgttttccaaagtgggtttacagctccctggacactcctgttcttcccacgtttgatatagctcttaggttctaacctctgccacttacaagttctctcatttctgacatcccatgagatgcaatcctttgatcttgatatcagttgaaatggaaatatctctgagtttcatttaagtggtgtcattttaaaaaacagtttttatcaattcaaagaatgctatttggaaatatttttgcaaagagatacccttgcttcgtgctattcaagcctgtaggcactcagacataaaaagctttctatgctggtcctggaatattgggttttaatgtaataggtttaatgtcttattgttaaaatcaggacccactttccatggtgttatgtctttatgctgcagagttttcacccaaaaattctcatgatagccctcacagattttaaggaatatttagcttcccaaaatatgggctgaggaaatatttgtaagacatggtcctcacccttaatcagattatctggtgatgataatgatgatggtggtgatgatagtgatgataataaaagtaacaacactactaattcgtaacatttattgagcacttacttactgtgtcatctcagacactgtgttaagcactttccatgcattaattagttaattttaaggaagtatgtttaactttacttgtttatttttattgatacataatatttgtgtatatttattgggtacacataatattttgttacatgcatagaatgtgtcatgatcaagtcatggtagataggctatccatcaccagaagcatttatcatttctatgtgtcgggaacatttcaaaacctctattctagctattttgagatatgcaatacattgtttttaactgttctatctaactgtgtttgtacccattaaccaacttcttttcattctccccctcccactcacacacactttccattctactgtcattctactctctatcattctaccctctacctccttgagattaaattttttagctctcacatatgagtgagaacatgcaatatttgtctttctgtgcctggcttgttttacttaacataatgatctccagttccattcccattgcttcacatgacaagatttcattcttttttatggtcaaatagtattccattgtacatatgtaccacattttctttattcattcatccattggtggacacttaggttattccatatctttgccatccacatattaattaatttaatcctggcaaaattgcccatgaatgaatgttctcattttacagatcaggaaactggtgtcagagaggctaaatgacttgccaagatagtagagctgacttcagagaatttcctttattaagaatgctttggatacatcatcttattttgttctttcaacaatcctgtaaggtaggagcattagctacatttttccagctggggaaactaaggcttggagaagttagttaacttctccaaagtcagacagcttgtattcacagccaagctgggatataggacaacaaagcctgtactcttaaattacaggctaagttaacacctattatagaggcatgttgtctaacaagaaagacattgtcattaacatggagtatgtctagataatacacaaatacacatgcacacacaccctgcaccttaagagaattagaatcgcaaagcacttttatatagcttagaagtgagagtttgggaaagttattctcagaggtaatggtggaaagcaatcagatagattggagagtttttgaaaacacctaattacaatccagcaggtgtatacccctaggcaccttcagcaggtaaaatggtatctggggcctgattgaatatttctttcactaggtgttcctttctgtctacattgtgcttctgtgagctgagagatttaataacagatgctctgggatgattcctaagcaaaagaattgtcttttgtcactgtagatgcattttccgaccttgtgttcaccatgaatatatcataagagaaatgatcgcctgacacacaagcaatgggaagtgtaacctggggttgggtttcacttgattgtaattacagaatctcagcttcattaacatacgtttttatacatgaaactttttttctcatagtagcccttatttgaaatgaacacctttcagcttcaaggccacaacaattatgttcaggttgaagagcagtttgtttctacttatgtgagagtaaacaaaacaagttattgtctctgttttccttccccatttgtgtttggttctgtgtttgctgcacggcacaccaatactaaacacttctcatttgtcctaaagtgagcattggatgaaatggctctatgtataatatgggtttgtattctgttgtctcaaagcagttacttagtgttttgaatccatgtcgatttaatgatcttattcattcaataagatatgagaggaaggaaggcaaacatgtcccctgcctgtatgtggcttatagtctggcagaggggtaaggcaggatattttgtctatcttgttcactgctatgcccagtgcgtgcctgggacttagtgctcaataaatacttgttgaatgagtgtatgcacaataaaatagattaagagctatgaaagaaggattactagaggaccatggaaatgtacagtgctggactgatttcctgcagggaagggaataaagagttgaggcagatgctctcagaaagagaattcccacagcatggcacaataaaatatggcccccattgtcacgtaaatgagagtatagatcctacttccacatttgccaggcctgaaagtgttgacaggttattcctcccaagcctcaggtttctcaattgtgaaatagaaaattatgcatatgatgctcttgttagtgaccagcacatgatggacagtcaatacctgtagctactgttgactgcaaagaacctgttgtggtctcactgtgcagaattatgttattcctttcaaatgaaacttgcagtagattcagtgttttaacagaatcgtgatggaagtcaataattgaatgcatcaaatgggggaaaaaaagcacaacctctcaactcgagatattttaaggtgtgactgtttttttttaaatgtttctgttacatgcatctaaatgactggtgtcttcttaagaagagcagaattttctattatgctgtgccacttctgtcttttgatttgggggaagttgctagatctcccagaggttcagtttccaataccataaaatggaaagaataaaagtaaatatataaaggcattaacttctatatcttagtgagtttttactaggcctgtgtctgcctaggatcttcttttttgattcatctattcaccaaatatttagtggcctctggtgatatgcaatgcattgtgccagtcaaatgatgagatatctgcttggaggagcaaaagatagggtggtgggcagagacggacttatgcaaattattccaatgaagggtagtaagtgctatggtagagggagatacgaatgctatgagcatattactaatagccaaagcaatcctaagcaaaaagaacaaggaggtatcacattacccaacttcaaactatactacaatgttgcagtaactggtacaacatggtacgggtacaaaaacagatgtatagaccaatggaacagaatacagaacacagaaataaagctgcacacctacaaccatctgatcttcaacaaagcagacaaaaataagccctggagaaaatgactgcctattcaatagatggtgctggggtagctggcaaacctcatgcagagggataaaactgaactcctacttctcaccatatacaaaaattaacccaagatgaattaaagacttaaatttaggacctcaaactgtaaaaatcttataagaaaacttaggaaatagcattctggatatcaatcttgggaaagaatttacgactaagttctcaaaagcaattgtagcaaaaacaaaaattgacaagtgggactcaattaaactaaagagcttctgcacagcaaaagaaaatatcaatagagtaaacagataacctacaaaaggggataaagtattcacaaactatgaatctgaggaaggtctaatatccagaatctatcaggaacttaattcaataagcaaaaccaaaatgaccccgtttaaaagtgggaaaaggacatgaacagacacttctcaaaagaagacatacaaattgtcaacaaatatatgaaaaaaatgctcaatatcactaatcgtcagagaaatgtgaatcaaaatcacaataagctaccatctcacaccagtcagaatggctattattaaaaagtcaaagacaacaggtgctggtgagtctgtggagaacacttatacactcttggtgggaaaatgaatttgttcagccacagtggaatgctgtttggcaatttctcaaagaactaaaaacagaactaccattcaacccaacaatcccattactaggtatagacccaaaggaagataaattgttctatgaaaaagacacatgcacttgtatgttcattgcagcactattcataatagcaaagacatataatcaacataggtacccatcaagaatggattggacaaagaaaatttggtacatacacaccatggaatactacacagccataaaaaagaatgaaaccatgccctttgcagcaacatacatgcagctggaggccactgtccttagcaaaattaacacagtaacagaaaagcaaatatcacatattttcacctataagtgggagctaaacattaggtacacatggacataaaggtggaaataatagacactggggacaactagaaaggggagggagggagagggacaagagctgaaaatctccctattgagtaatatgcttactatctagatgatgggatcaatcatacccaaacctcagcatcactcaatatacccaggaaacaaacctccacgtacaatccctgaatataaaataaaaattgaattaaaaaagcaaaaaaacccaaaagctataaacatgtagaaaggtcaggcacagtggttcatgcctgtaatcccagcacttagggaggctgaggcatgcagatcatttgaggttaggagttcaagaccagcctggccaacatggtgaaaccctgtctctactaaaaatacaaaaattagccgggcatggtgacagggcctgtaatgctggctacttgggaggctgaggcagggcaattgcttgaacttgagaggtggaggttgcaatgggccaagagcactccagcctgggcaacagagggtgttggtttagcatgggactgtcatggccaccagattggtcttttgctttctgaatctcatttccaaatttagtgtctgatactgcttgtcaatacgtctttcatgcatgtttagactccactcagctcaattccattctaagcattcttttgtcatttatcattcaatgattccagctatctattgacccaatataaatctattaatcaataaaggcatatttcctgatatctctttcaataattcaataaagggatattttttgaacataccttgtgtttcagatactctgctctgaaatcaggaatgaatgagatttcatccctcttcttaagaatcctccagcctaggaaatgatgtaggaaagatacccattacgatagcacaagacaaaacgtgatatagccatcagcaggaacaaaaggtgggaaaacaatatatgttggcacacctagccagcatcacatgtttagttacctgttcattcactttagccactagaggtttagacacctgttttgttttgttttggtgggaggttgattttatttaatttttattttaagttcaagagtacacgtgcaggtttgttacataggtaaacttgtgtcatgagggtttgtagtagagaatatttcatcacccaggtattgagcctagtacccattagttatttttcctgatcatctccttcttcccaccctccatcctctgatacagacccctattttagatatgggaaataggagaggtcaggccctcaaggtaggtgtgatttcaaaggcttgaaggtgtgatttctttttttatttttatttttattttatattatatttttaaaattttattattattaaactttaagttttagggtacatgtgcacaacgtgcaggcttgttacatatgtatacatgtgccatgttggtgtgctgcactcattaactcatcatttagcattaggaaccaacccaaatgtccaacaatgatagactggattaagaaaatgtggcacacatataccatggaatactatgcagccataaaaaatgatgagttcatgtcctttgtagggacatggatgaaggtgtgatttcaaaggctttgaatgacaagtcaaaaggttattcagtaggaatagccttccatgttttgaagaggaaaaaggagcacacaagcagtactaaaaagcaatacttcccatgtcttgtgagaagactgaggctgagaaatgcaatggagaactgagaccattgctaggttctattggagacggtttctcttgggaagacttcaggtattttagagtagagtcatgtcatggagtgctctccaaaaactggcaaattcctcctatatccaagcagaaattttctttacttttggacaactcctgatgcttatgtgaccagttactccttaagcatattttttgagacccagattaacacagatctcaaagtggatggttccagatagagaaaattgcatgaagaatgctaagtaggtctagattcttcaaggtgcggtagggtcagaccaattttttaatcaagtgtcttgtcaaaaataaaaatgcattacagattttgtttcattttttacaagaataaaggtgaaggtgttagagtagctgatacctttttgacattttgactctggaagttattatgcctttagattcagtggaaatgcttcctttatttcctcttacgctaattcattttaggtagaaacgtcaatgttggcctaatatgtgaggccgatggcatctcttaacgtttaaaagtctgttaactctcctactatgaaagttctaaaacctctgtccaattctttaaatactctgattaagatttaaaaggctacttttttactaccatttaattatctacttcccaggtaactgtgatattacaattttgcaacatcctgtagctctttgtccaaccattcaattatgtatatagcaagatttttaccctaccataattaataggggaaccaagtagaaacattaatgtgaattaaccgttaaaatgcacagaaggctggctctcatattttttcccatactgaattcctggagttttacccaggggtgaggctcggatcagcactcctataaaaaattgtcaaacttgctgttatatactatgattattataagtttattggtacatttctaagtagataggaaaaagatgcctgaacttgcaggttatctctgcttttaacttgtttttaccattggccaggaggcaagttatataacctcttggattcttagatttctcttcaattagttacagtctgtaccacctttagaccaggccaactagccctggcacaaggtcttgggcttaagggtccagctctggctttcttatggttgtgctcctatgaactaagaatgcttgggccaagggctgtgtccatccagaaccagtgtcctcctacccaaatcatgttctgggtactggagaccctaggattctcagcataagtggccctgaatctgtttccagtttctttcttccctgagtttattctcttaaggtcagagaagaatgctgggtgtgtgcatgcatgcatggagtgaccaaggactatgcattacccaagtttggagataaagggctctggtgtccaaagtcatgtgttctgttccctgcagtgcaggctggagccagaggtgaggatgaggggaagtgggttcagaagtttcaatttgtactcttgcttcaggccctgcaagtgttgaggcagatttggttagaactgttaattcccaccttttaggagaaagtgcaggggaattagctgcaggctgcaggaagggctgacccaacatatttgaggaggaagtgttgtatggtaattgtggttaaaggtttccttgtttttaaacatgcttattaattatatgtcacagtaattccagccttagctgttcattcctaagttcagacactaaatttttgttaaaatatgaataattattaaaggggaaaatacatctttattattcagcagaatcaattaacatatttgcatgcatttgttttattagccagtcacctagaaaagctcagaggaaaagccacaagattagtataattcactcatgttgaattaataagtgtctggaagagtatcagaattccctgaatctgctaagcttttaagctttagcacgctaattgtcatcaccaccgctactaccatcaccaccaccaccatcatcatcatcaaaataattaaataccagtagctaatactcactgagcatttgttatgtgccaggctctgtcctaaacaccttacatgaatcacaaccttcagttctcattgaacctatgaagtgggtacttttattacctcatcacacagatgataaaacatgatgcacagagaatacaaatgattttctcgaatctcagagttcctacctatgaaggtagcatcaggatttgaacccaggtcttcagacagcttcttcccattgacttaagtttcccactttatttgcatgtgtctttcatcagcctgatttactgactcatcctttatgtgtctccagtgcatcacaggaatttaaagtgtaatgttagatcatcttgtgtataataattagtctttactgctcttattataataactctcacattctgtactcatggctactttataccagtctgattctggtcattaagaggcagaggggattaaaaaaactcagattaatatgggtctattgtgtttatttagctaactactagggtgatgaacttagataaaataattacaaggacaattgtctaagaattcttacatcattcaattaagtctttattatcttttcaagtgtatgataaaatatataaattttaaatgtggaaaatatatgtaaaaattgtaaaatatattaacagaaaaatttattactttttatttatataaaaacaatatttgattacttttattgtggttaaaaatatcacattcctagaatatatatagtctgctttaaatggaatatattgtcattaaattttatttatttttaaacaaattacattcaaatgaattttctcttttttgagggagtggaactaaagatctgtaactctaaaccaggaattggcaaactatagcctagaagccaactctggcccagagccttttataaagttttatttataaataaataaataaagttttatttgaagatgaccaagctcatttgtttacacattgtttatggctgcttttgtactataatagcagagttgaatagttgtgatagagaccttagggcatgcaaagactgaaatatttactatctatcctttgtgggaaaaagtagtttgttgacccctcctctaaactatgtgtctgtagcagtctgcttttgcattgcaataaaagaatacctgagactgggtaatttataaagaaaagaggtttattttgagtcacggttctgcaggctgtacaggaagcatggtgctggcatctgcatctggttaaggcctcaggaagattccagtcatggtggaagcaaagggagatctgatgtatcatatggtgagagcaggagcaagagagagcaaggaggtgccacactcttttaaacaaccagatctcatgtgaatcttcataggatgagaactcattactgtgagaacaacaccaagccatttatgaggcatctgccccaggatccaaatacctcccaccagactccacctccaacattggggatcacatttcaacatgagatttggaggggacattcaaaatatatcagtatcaaaacaaaaatattggttggcacacattccagtagtaccatagagtcccctaacatttgagactttgcaaatggacagaaacacagtcgtgtcaaaataatttttagactctaaaatgttcagccagttaaacaaacatgttttattttattgttaccagaatttgaaaaatatcacaaaatcaaggtgaggttatcttaatcctatgactgctctttaagcaaacaatatgtttttcaaaattgaccaaataaagcaaaagagatgaaaaacaacaacaaccatagaaggtattgtgacaaaacacagaatcaagtatttactttgtttaatctaaagcagaattaaaatgggagaagataaataccaaatttcacgtgagaaataactattttctgctaagtaaacttattaaaaaaatacagtcacacttttttgccactaacagaggatcatttgcagaggcttgtctctatgtctctattaaggggatacagtgatgttttcctaccttgattagattattcaataatttctttgcaagagatttcagctgcctccctatgtaaaccaggcctaatctatctggtatttacaggttaatcccttaaagacttgtggacaggatatgtcagaaactggtgttggcttgagagacagcctactgtaggtaatgcaagtgttgcttggtaaatttgatgagcctaattcaaccacaattttcaatatctaatattttattcccaggtatgcttgtttaaaagaaattttaaaatgccaaaagaaagcccttctatctaactttcacacacaaaaatcacatggtgataaacacaaaagtagatttcaaaaatgttactgggacaatttggaattcatatgcaaaaaaaaaagaacgaacgaaaccacaaacaaatactctagccatacttcacaccatatacaaagattaacttgaaatatataaaatactaaatataaaattagaactatgaaacttttaggaaagtgctatccaagtggaatactgaacaatgatggaagtgatcagcggctgttctgtccaatgcagtagccaccagccaaagaggctattgagcccttgaaacgtggttagcataattgaggaactaaagttttaatttaatttgatttgatttaatttaaatttaaggcaccatatgtgactggtgattgttgtgttggacatcagagttttagaagaaattatagctaatacatatttgtaacttgagtaaggcaacgatttcttagggtgaaaaagaacaaacaatgaaagatgaaaggtaaattaagctttatgaatacaaaaatctatgctttataaaatacactgttaagaaagtgaaaaggcaagtcgatggactgggagaaaatgcttacaatgaaatatctgctaaaggacttgtattcagaatttacaaaacattatcagaatgcactactaagaaaaccaaatgggcaaatgatttgaacatatacctcaacaaaaaaatacagaaaaaggcaactacacccaagaaaaagtgttcaacatcattagtcattagggaaactcaaattaaaactgcaagatataacattatacctctaaaagaatggctaaaataaaggggaaaacccctaaacatcaaacgctggctaatatgtggaggagctgaaactctcatacattgttggtaggaatgcaaactgtcaaaacacctttgaaaaacagtttggcagtttcttataaagtaaaatacagatttaccatattactagcattgtgctgcagccaaacattaccagttcataggagccaatcatgcacatctatttctaactccacattcagtgatgccatgttgggagactgaagcggtttagagtaggagtatttacactgcaggaattggcaaatgctacaaatcagagactgttttggggaaaggggaagagtcaactattaaatgtctaccagtaaagtaatccatatggtccagcaattctagtcctagtgaaatgaaaacatattcatccagatacatgtacattaatgttaatagcagttttattcatacttgccccaaactggaaacaatggaaatgtttattaactggtgaatggataaacaaatttattacatttataaatgaaatattactcagcaacaaaacataatgaactactgatatatgcaaaagcacacactctctttcctttaaaaataaaagcacaaacatgaatgaagctaaatcttttctttgggatctggttctacagtattttcttctaatgttttcaattgtcacaattgtttggacctgaaaggtacttctgaactgtcaagcgagctatagttgctattagtccatcaaatgaattttagagatatgtcatatcttttatgagactaaagagcttagaattctccctctcaattaagtttccaggagtggctgcatttaatatgatttctgatactctgacatagcaccaattaacagagtctagttttaaatccaaattcaaagagcaaatgtcttttagcacataatttaatgtctattccaatttaccacttgtgtttttgttgattttacagaggcccttggatggttctgccctagtcattagggtactaattctgttaaatacttgttaagaactacattacctactcatgccaaaccctggtgattcaatgctataacgtatgggtgaggaagtgcagaaaatgacaggctgattggattttgtttttctaatcacattatgttctaatacttctgaccaggttgtttaaggattttataaaaatcaccttttacagaagtcacctttcacctttcattattgtataactttatgagagagatgtgtcaaatggtatataatagcttattatttttgtcctctaaagtgtttatttcacgtcaaaaaaagtagaaacttgttagataagagctgtgagagctccttttgaatgcaacaaactagttgaactgaattgtattaaatattatttttctaatgcatcaatggtcccaagacaaaaaaaagacaaaaatgtttgtttacatgaagtaacttttctctatgaaatattcaatgtaataaagccaagatagtaggaaagatgttttatttgaaggtgtgtgtgtgtgtgtgtgtgtgtgtgcatgtgtgtgtgtgtataaagtagtgaattaagcattatgacacactctagccactggctactgtgcctacggtattaggcttgggattccacaacatttgttggtgaatgccctgggattaaggttcctggaaatcattgccaaactagacaggaacaaattaatctagacagcataaagcttgacaagcacattagtaatttttaacatctggagaatactgtcattgctgattagatgaaggtataaaaatatacctaaatgaaatgttcaaaacaaaatagaatatgatttttaaaatttctgagtagcttaatttgtcttttattattataaaaacataatatgtaaatgaaatactaaaaacagagatctagaagtagaaaataatatttaaccaatcccatttcactctgtagaagtgacttatacatatatatgtatatacagagagattttaaaaataaaaattctatcatgttgccatattctacacattttttttcaattgctaatttatcattaacttcttccatgaaaatacctacagatcttcctcaaggatgcatataatgaagctctaaatgtacttagccaaagccctgttaatgaatatttaaagtttttctctattatggtgtgcattgttgactcgattatttgcttgcttctgtgacagtccctttggataggttagaagcagatttttgagttgaaaagaaaaaaaaggtgttttcttgagaaggaaattgggttatattaagttggagatttggagtgaaggatagaaaagaagaaaattagattgccataggaaggctgatgatttatgtgtaagatccagtgctgtgtgttctccgtttcagcaatgtggcatcattgtgcgacatactttcatgtgttatctgttcatattgacttgattttttaatcaattatgccattttcaggcatacttctttaaattggaaaaaaaatattttcagattatctttgactgaagtttaattgcatggaataaaaagaatatcaaagtggcaaatgctatgtaaaaaattaaatagagtaatgcacaagagcattggtaaaggaggaagactttagctgaaatgatgagtgaaggcctcttagaagaggtaatattccaggagaaactgcatgaccaagaggaggctgctcctcttgatttatgaagaaagagatttactaagaaaattgttgttgttgttgttgttgttgtttttcagataaaggaaactatgagtacaaataaactaaggaaggaactaatttggtttattcatagaacaaaagttatttcagtatgtttagagagaatggtagaggccaaaccatggaatgccttgagtaccagaataagaagtctgatgttagaaaaacaaagtacttcaagttcaactggaagctgttagagatttttaaactgcagagcctcataatatgattcatgtgattatgtggccaattttagttttattattttttcttttttttcttcaacttttaagttctgggatacatgtgcagcatgtgcaggtttgctacataggtaaacgtgtgccatgggggtttgctgcacagatccacccatcaccttgtattaagcccagcatccattagctattctttgtgatgatctcccccaactcctccctccaacaggctccagtgggtgttgtttcccctaccatgtgtccatgtgttctcatggttcagctcccacttaagtgacaacacgtggtgtttgtttttctattcctgttttagtttgatcaggataatggcttccagctccttccatgtctctgcaaagaacatgagctcattcctttttatggctgcatagtattccatgatgtatatgtaccacattttctttatccagtctatcattgatgggcatttgggctgatttcatgtttcttctattgtgaatagtgctgcaatgaacatacacatccatgtatctttataatagaatgatttatattcattcctttgggtatatacccagtataggattgctgggtcaaatagtatttctgcctctagatattcaaagaatcgtatgtggttaattttaaacatttgtttagtgaatggattaagaaaggcaagggtggaaaccaggaggcaaggtaggacaatatttaggtcacacaatgcagattgagagccatcatgcattaagaatgtattctggaggtaggaccaggaggacttggtgatgaattgcatgtacaatgtgaaagaaagagataaactatggctatcttcctatctaaaagaggcggttctttggcataaaagtaattttgatagctcatagtgcttggaaaatgaaaaaaaaacttggagtccagagcctaccattggtgggttctattataaaccctttctgctttggtctgggatcctgaaaggtgggtggttccctgggaacaaggatgaaccaaaggtaaagcagacatcacaaagacttcatcacagtaagagttgtttgaatgcccccctcctcccaaatctcaatctctaactctagaattaatgtgatcctgagctgctagggcatagctgccaagctgaaacaaaatgataatctttcctatagaaatataggctaccactacagatcaaattgttttttacaagcaacatttaaaataaaatgtccaaaacataatcaaagataaccaggtatattatgctgctatttcctagaccacattttgggtaggtgcaatctactagtagctgacttttcaaccgaaataatggaagccagaagaacaatgagctgatattttcaatgttccaaaagaaagaaagctgccaaccatgaattccatgcccaataataataaccttcaaaaaggagggcaaaataaatatatatatagatgaagagtgagtgatttttgacaataatacccaaagtaaaaactaaagaaagatcttacaaacagaaaaagaatgttcccagagagaaacttaaagaattaagaagggattcagagtaaaatggtaaattaattatgaatataaatgacataggcagaattaaaatatataatacttacagcataaacatcagattaattgtgcaaaagtgttctaagtttcttgaaattctgaggaagagggtaaaaataaaaacactaatcagcattagattatgctaagctaagaaaatatgttttaatctttaggataacaaataaaataatttcaaaaagtgtattataattcttaaaaagaatagtaggaataaataatccatgacacacacatgagaaagagagagagagagagagagagaagaaatgtagggcaggacaaattcttggtagattgttaggacattagtagtattcttagtagattgtttacaaatacattaataattgcattaaatgccccaattaaaagccagttatttttcagatagttatttcactaaaagaataggaaaagatactccataaaaacactgactgttgggtaatcaacgtctgctgcctattatcaggagtagaagttcaagcacttctgtccattgcatcttggtatcagagtcaccaatgaaaataacacagtgaagcactggatgaaaaaaaaatgctatactcatatagagaagagacagagcaaggcaagctttaacagtgggcatctgttccctgtggtcagtgggcccctcccaacaaaactcaaaaaaggaattacgggacaggacaattatgagtcctgtctaactcatgagtgtagaagtagaaattctaaacaaataattagcgaatcgaattcagctatgcatcctgctgaatgagcttattcagaaattcaaagttgtttaatgtttcttaatttttaagggtaatgtgccacattaatggaataaaagaagaaaatcatttcaattaatacagaaaaagtgtttgataaaattatttcagagtttaaaagttcttactaatcaacaagataatttctttaatctaatacattatattggccaaaaccataaatagatattatatttaatggttaaatattgaccccctccccattcccttagagtctgggactaacaaaagatgcctgctataaacattattttttaatgttgtatccttggccctagatagttcagtaatgcaagaaaaaaataaggattggcaatgaagaaataatacattcatgattgacagatgttaaaataattaataggtgatattagcaaggttgctgaataggtaaatataaaaatcaattaaattcctctatgccaaaaataaacagaaaaaaatgaattaaaaataccgtttataatattatcaaaataatcaaatactaagaatgcaattataaaagatatggaatgttcctatcaataaaatgacaaaacattatttaaagaaatgaaaaagacctacacataaatatatattatattcatagactggaagaaatttaatcttaaagctatcaattattctcaaattaattttttagattactttttacactcaatgtcgtgtatcagtaacttggcaggtagaattttagaaattggtgagctgattctaaaatgtatatggaaatacaaagccctattaatcaagacactcttgaaaatcaacaataagctgagagcaatttttcgcaccagatcccaagatttatttgaacactacagtaactaaggcagtgttatgttattgtgaggataggcaaagattgctatagaacagaatggatttctgcaataaacatgtacacataaggacacttgattcaagagaaaggtggtgctgcagagaagtaggaaagtgatgatcttttccataaacggtgctgggaaaattggaaatccatatggaaaaagcaaactgcacacctgactcacaccatttacaaaaatcaaatccaggtgaatcaaatacttacatgtgaaaggtaatacagtaaatgattgaaaataaaatatgggagaatataagcttggatagaggaagattttaataaataggactcaatattattcattaatgttaatatcgacacatttagatacattaaaacctgtcttcattaaatgatttcataacgaaaatagaaaggttctcacggcatggaagaagaaatatgaaatgaaaataatcatcaaaaggtttgtataaagaccctatgcaaggttcctacaaagtattaagaaaaaaagaaagtcaatagaaaagtggtttgtagattagttgcagtagtggccctggccattcatttcctcctttatccatactttttgtgactttgcagtaactctcatcaaaaggtagagtcttgtgtaatttgctctggccagtaaaatgcagcagaagtgacagtgtgacagtttggggtgtagttttttttgtttttttttttttttttttttttatgagacagagtctcactccgccaaccaggctggagtgcagtggcacaatctcggctcactgcaacctccgcctcctggattcaaacaattatcatgtctcagcctcctgagtagctggaattacaggcacccgccaccatgcccagctaatttttgtatttttagtagagacagggtttcaccatgttggccaggctggtctggtacagatctctccgtgcccttagatctcttggatcccagatagcctacaggaggacgtaggagacgtggccttgtcttccccacagccccatcctaagctggccaattgccagacatgtgagtgaggccgtcctagaccatccagcccccattcagcctgtatatgccccacagaccagtcacaattagctaaacctagcctagagcagaagaactatgagctaaataatgcttattgttttaaattactaagttgtagaatagtttgtcactcagcaacagctaaatgataaaaataggcaagggtcttaaaataagttacttcacaaaagatcatatacaggagccaataaacttatgagatgatgctcaatctcattgatccttagggaaacaaaacttcaatgagatcgctaccagaataactaaaattaaagcctaacaataccaagtgctaaaaacgatatgagcaacttcgattttacatgatgctagtaagagtgtaaattggtatgaaacactttgacaaatattggcattagctaatacaattgaaaatgcaaacattttacagactagcaatttcatatctagctatgtgcatttgtatactaagaaatatatatgagtgttcatatcagtattatttataatagccctaaacttaacacaacttaaatgtccatcaattgtaaaatggatagtgatatactcatataatggaatcctataaaacagtgaaaaggaaaaattacagttaatttttcactcacatggtgaatattgggcaacagaagtcagatttaaagaatgcctgctatattattccaattatataatgcttaaaaataaacaaggcaagtaaggcaaaaataaacaataacataatttatagttcatagaagacaaatgtatgaagaaaaacaaggaagtgataagtaaaaatgtcagaacccctggttacatttagaagggaaagaggagattataattgggaagggacagccaggagccttctggaacactggcaaagttttatttcttgacttgagtggcagttacatgacagtttgctatacggtaattaattagttagtgcacttatgtgttatgcacttactgttagcatggtatattccataatgaaactgttaaagagagagaggcatcatgggagttcaagagtggcatttgtgaatctgttgcttacaacccaatcagcccattattgcttcccagatgataccgctactatgtcatctgtgaagcaaaaaaatgggttggccagataagcgttaaatctttctttatcattttggggtgctaagtgtaaaagtagaatgctagtacaatagttctggcatacagaccaaataatgagccctaggattagtgagaaatgactattctcacagtcatttaatggaacaggttgaggttttgatgtgattttgagtagcaacccacattagctaaggtgctccttagagtgctttgtttcttgctccctgaacggtcagtcatgccggaggcgtggccctgtctctcagttttgcagaccggtcagcagaaaacacagcagaatgctaaccaggagatgcctacaccttattggtttattcccatgtgctgctccccatcctatttttttgtgtgtgacaagatgattgtttatctaattcaaagcctgctcaatgtaactagggatgaattagaattgcttgtaatccttgtgtaacacatgtcctgttgtcaccacaaaacatttctgtaaaaataaaatttggggatgaaccaccctctagtaatgatatggaagaccaccctctaataaaaatatgttaatctgggctggacacggtggctcacgcctgtaatcccagcactttgggaggccgaggtgggcggatcacgaggtcaggagagtgagaccatcctggctaacaggatgaaaccccgtctctactaaaaatacaaaaattagcctggcatggtggcgggcccctgtagtcccagctactcgggaggctgaggcaggagaatggcatgaacccaggagacggagcttgcagtgagccgagatcgcgccactgctctccagcctgggcgacaaagcaagatgccgtcgcaaaaacaaacaaacaaacaaacaaacaaacaaaaaatgtaaatctgagaaatccttaaagattaacatgatatttatattatacacataaggaaattttatttggctttcttatataaataaagtgtaagtatctcaatcagccacgctacttataatgcacatatatgttggcctttgtatattgaagaagctaatttatttgtagatcattcattcaacttcgctatttctctgttattctttcaatgaaattaacattaacaatctaattattcccaaccatagttatagaaacaaaggttgtttgaccagaggtctcacctggagaactttttaaaaagtaatgctccccaagctctaccctagtttcaggtcatcaaaatttgtcaatatcgcatgatactattttgtttacctatttatctttgtctgcttgccccctcatctctgctaaaatataagcttcatgaaaacaaggacctctggacctagttcacccttgtcttccaaggcacagaacaaaggttggcaactatgacctttgggccaaatccagcccacctgcctgggtttgtaaacaaagttgtattggaacacagcattgcccattgatttacttactgtctatggctgctttcatgccaccatgcaagttgagtagttggtgacagagaccatctggcctgcaaaacctaaagtatttactgtctgcccctttacagaaaccacgtgctgatctctgatttagaaaaatggctagcgtagagtgggctctctacatgtgttgaatgctgaatgaatgaaataatcatttattagtgcctctcagcagctctcttttgcgcaaataagtttctttttccatgttagccttaattaattgttttattacactgtggtctcttcttggaaacttactctcctcattgcattattaagtacccttcattttcccttggagccagtctggggttttggttatgctaaagtacaatgagatatgggaagatatgaatcaatttacgcaaaacttctcaggagcacattaattacatactatgagattttttcccaagctcgctttcattctcagaggagtggcaacagtgtatcagattacaagttaaatggaaagccaagttaataaggatgggatgtgatatattagagtagcgggtatgatttgctataatccccagctgaatttaatgataggttatcagcattcagggatgaagtacactatctttcaatagatagcaaaagcacagtgaactatttctaggtttttaaacccgttaactctctatataaccttgggcagtgggctacttctgcaaatgagagtttcacagtctcttctttagtaaccagaaaaatctgggttaggtgatgtttatagttgatcgtaattatattgctttataaatagggaacacaataacaaatagcctgaaagtatagtggaatcacagcttaatgtaagtgttatgtcttaaaaattttcatcaatttataatgaaagttttcatatagttaaaattacctttgatctttatgtggccagtacattttttaaaattgtggtaaaatatgcacagcatacaatttactaccataaccatttttaaatgtacagttcactagtgttaattatattcccactgttgtgtgaccaatctcatgagcttttcatcttgcaaaactgaaactctataccagtggtccccaaccttcctggcaccaggaactggttttgttgaaaacaatttttttcatggaccgagggtgggatggtttcaggatgattcaagcgcattacatttattgtgcactttatatttctattattattacaatgtaatatataatgaaataattatacaactcaccataatgtagaatcagtgggagccctgagcttgttttcctgcaactagagagtcccatctgaaggtgatgaaagacagggacagatcatcaggcattcgattctcaaggagcacacaacctagatccctcacatgcgcacttcataatagggttctcactaccataagaatctaatactgccactgatctgacaggaggtggagctcaggctgtaatgcgaaccatggggaacagctataaatacagatgaagcttcccttgctcacctgccgctcacctcctgctgtatggcccggttcctaacaggtaacggactggtactggtctgtggcccaggggttagggacccctgctctatacctttcaacaactctctatttcctcctctttcccagcacctggcaaccaccatgctaccttctgtttctatacattcgactactgtagacacttcaaataactagaatcatgcagtatttgtcttttttgtgactgacttatttcacgtagcataatgtactcaagattcatccatgttgttacatatagcaagatttccttccttttttaggctgaatgatacaccattgtgtgtatataatgcattttacttatccattcatctgttgatagacatttgggtcacttccatctgtgcactattgtgaataatgcagctatgaacacagatgtataaatattttttgagatgctgctttaattctttttggtatatacacagaaatggaattgccaaatcatatggtaattctatttttaattttttgaggaatcaccatattgttttccacaggggcaacgtcatttttcatccccaccaacagtgtacaaatgacacaatttttccacatccttgccaaaacttattttcttttttttgggttttttttttgatagtagccatacatataaggtagtatctcattatgattttgatttgcatttccataatgattactaacattgagcatcttttcatgtgcttattggccatttgtatatcttctttggagaaacatctgttcaagtctttgcctaatctttaatcaagctgtttggttttgttgttgctgttgttgaacagtaggagtattttatatattctgtctattaactctttatcagatacatgatttacaaatattttctctcattccatacattgcctttccactcttgatttttttcctttggtgcatataagtttttaattttgatgtagtctaatttatctacttttgcttttgttgcttgtgctcttggtgtcatatccaagaaatcattgctaaaatccaatgtcaagaagatttcccctattctttcttctaagcttttaagtttaggtctttgatccacttttaattaatttttgtatatggtatatggtaagtgtccaacttcgttttttttttctttttgcgtgtggatatccagttttctcaacactatttgtggaatagtttgttcttttcacattgaatgatcttgcacccttgtcaaaaatcatttgagcagatatgtgagggcttatttcagagtgctctaatttgttctattggtctatatatccatctttatgccagtaccacactgtttttaccactgtagttgtaattagtttgaaactaggaagtgtgggaccgtcaacctttttcttctttttcaagattgttttggctatttgggtttcccatacataccctagtgtcttgcaactctataaagtaaattttaggtatactccatactcaagtttgagaactattaacctaggttaaagtaaggggaaaaaaggagcatccatatgcaaatgtctgctaggtgttttcagtccattcttcctttaagagaactatgaaatccttaaaagtcagagcagggtaggatgtgggagagcagtaaaaaatactcaagtggtcctgcctacctgcaagagtttgtcattcagttttcatagtaagcctccatatttcattttctttctttctttctctttctttctctttctttctttctttctttctttctttctttctttctttctttctttctttctttctttctttctttctttctttctttctttctttcttttttgagacagagtctcattctgttgcccaggctggagtgcactggtgcaatctcagttcactacaacctctgcctcctgggttcaagtgattctcatgcctcagcctccaggtagttgggattacaggtgtacagcactgcacctggctaacttttacatttttagtagagatggagttttgccatgttggccaggctggtctcgaactcctgatctcaagtgatccacccacctcagcttcccaaattgctgggatttcagatgtgagccactgcacgtggccaacctctatatttctatgtaaatctcttgctgtagtgagagggttacagagatgatacagcctcatcttacctgtggtgaggttcacaaacttaaagaaaagggccacatgaagagaaagcactacctaacttcatgtttctgtgcaacggatatttattgtgtgcctgctgttttatgaaagtttatggaagaagcatgttttctcatgagtctttggggatcgttattagaaacctatggtaggggatctcctcaggggatttcattctcctaaaaaaataaagagaactgtctgaaatactaaaggcattaatatatttttcccaggtacctatcacctttaggaatgtgatgattatttccagtttttatggacacatacctgaggaggctaattaaagaccatttaagaacttcatacatgacttagatggaggcctaaatcacaaattcaattcctgtttggaatcaatagtctcttcttgcttacagtcgctttttgtctcagctcatgtccattactgagtcatcagtattgggatgaaaagccaaaatatagatttctccaaggaaaagtatattttatttctctttgctcataatgtttcaatgcaggctgaaaaatgcttttttataatgcatcttattctaattattcacagaacacattttaatttagacttctcaaatgtacattaatgtgtgtgtgtgtgtgtgtgtgtgtgtgtgtgtgtgtgtgtatactatgtatatactcctaaccagagctcctatgagttaactcaagtcattctggctcaataatttttaaatgatagagagaaaataagacgatttccctgtgtttttgaaaaccctggcagaactcattattctgtgtcactggatctttcacatatgcaagtttatttttggtgttccaagaaatctgaagttcactaacaaggtttttgaagaacactcttgaactgaatgtacaggctgtagttgaataagaacagagtgtgtttggagtgcaaatgaaccagctgggatactaaattctcatcatgtccctaattcaataacatgagtttttctaattcttttaaaattatgtagtgttcatggctgaatataaaaatactagtatataaatgtacataatttactattttgttcaacatcatacctttgtcatctagatctatcaaaacgtagcatacactgccatttatatcaattgacaatgaattcaaagaggggtgtccatcccttccaaagtttaagtgtggttcttacttaaagtatctgtaattttgcaggcatcctggaatgagttctgtaattttgctgggaggagggaagattaattgcaggatgtttataactatattgaggtattttgcattcattaataatgccaactaatgtttatagaacactcaatatactctcaaaacaaagcactctgctaggcccttcgttgtattgttcttttacgttcacagctatctcatgaggtgggtactctttttaactccattttaccaagaaacaaatggaggtctgaatctgggattcaaacctcattctgtctaactcaagagtcaaattttcatgatactcttctctgtctaggtctctgatatgactgttctttatatattttttttaattctgaggctttctatgtaatttaactttcctaatgattttgagtatttcccattccagcatatggccagcatttcatgttcccattggcaatgacaccaacactaggagaagtgacccctgcaatgtacaaatttcaaaatgtttataaacacacttgaccagaagaatgttttatcttctgtgtaatgccagttatcaaaaattaaataatcacatgtgttctagaggaagtgaagattgaaaaagaatcgcaaatgaagacaatagaatgaaaagattatatggatctagatgtaaatgtgcaacttaagcaatccacatgacaggaacacttaatcctgtatcaggagagaaaatgagttaaatatgaatttaggaccataccctaatgaaattcaatgtcaagataaacctaatagtctgtcattggcatactttacatttgttttgtaaaaggcaaagcctgaaaaaaagcaagttgcttataatcccataaatagaacttgaaataaataagaaatttatttttatatgaagatttcagttgcttttaccataacttgcttcatgtcatttctgtatatgtgtgtatatatatatgtgtgtgtgtgtatgtgtgtgtgtatgtgtgtattatacactagatttttacattttcatatgtgcatctgtattttacatctatatatattaaatatgtatatgttttacacacacacatacaccaaattttcatgactcattagggagaggtggctaacctactagaaagagcagtaaagaaaaaaaaaacccttttttttccaaaaatctgtctgtagatttcttccttcctcccttcctcccttccttcttttcctccctaccccagacatttcttgcacaaatgtttcctcttgccttaggaaaatgtatgatttctctcttgatgacactccatcaagctccttcttaggtttgcatccttagatgctaagatgcattgtgagtgcagaagagtggaggaaagtagaggcactcaccagggagaaggggcgacaggagcacagagactgggctgttgccttcggaatagcatctaagggcttggcaaagggtccacttggtttacatatttctcaaagtacctggggaggagggatgttgtccaataaaaacacacggatgaaggacactgaagaggaacatggagagaatggaaaacagtcatttcctcttgcgcaactttgccccaatgtagaggagtcctgcctgagataacatagaactttccctactatattgcccaaggagacatagtgggttgacatgtttgcagtgatctccagtctggtaagactttttcacttttctgaaaagagatggtctgcccttgatagttttcattaaatggttgaatctatttcattcagcatgatttcatctcttcccagttaacacagtggcttggtctaaagttgcctttagtaaccaactggtttaacattgtgtccatgggaagtatttctaaatccacgtgattgttcacctgaaatttggtttcagattgaataataaactggttatttgtcccactgcaataagccacttttgctttctgtaaccagatgctctaggaggatatctaccctgagtttatactctgacaaagaacaacacttttttttccaaaaaaaaaaaaaaaaaaaaaaaaaaaaaaaaaaaaaaaaagctttcttttgattcactagaaactttagctatcactgtccttcagtaatcttgggtttttaaaaaagcttcctcaggtcagaccattggactatgttaggtgtgagggtctggagtccttttaatgttgaaatttttgaagcgtttgctgatttgattatctgtgttagccttcatgtatagagagtttgagggtttcttttttttatttgaagtaagttaatgttgccttcagcttaattaatgaaagttttaaatgtgctggctgtaagccttgtcactcgatggtaacagggattttataattattgggggataaaacatgacagaagcttcttctattttctttctgtctggtctcactgttcttagcagttgatgcagctttttgtcactctgtactttctgagaaaacttcctggctaatatgggagttatcagataactttacgtggtctgcctagagatgtctgtatgtggcccataaggatgctcagtgggttataatgtctctgagactgtatataaaattgtgtgatatgtgcatttgtgagggaagcctactcatagcattttgttcattctcaaatggaatcatgaacatctaagttaatagtttgggctcttcccatgcaagtgtatggtagtggggagaaataatgataatagccagtgctctactatgttatttccacagtgtcttaaacactgtactatggaatttacaaatattatctaattaattagtcactctttagtgcccatgttgcagagaaggaaaccagtggctggagaatttatgtgagtcaggatttgaaccaagtcagtctaggtccagagcctgtgctcctagccccttgagtgaacagaggttctgaaatctgctcattcactacccacctgtgacatgtcactgtccaaaaggcagaacttctgctgtcttagagcttctgtaagtatgggtaagagggtaaaaataaggggaggcaggttagagttggggtttccttggataagctctgcattttctttcacttttggaatagaagcaaacaaaatcgtcatccacttggcgttgactgagactcttgtaatacctgaatgtgctcgaaatagacatgaaaaggatgcatatacttggaaggtggaagaaatgctcaggttttcctttaggcctagagaagtagaaggtagtgagcacacaatctggattctgagttcataggtttgaatctttatcctgcatcccactgtctgtttcaccctgggtgaatttcagcacagcacttctctgtgccttagttgccttgtctgtaaagttggactgataataatggtacttacgttactgaattattgtgaggatgaaaagggctgatattcataaagcacttagaagagagcctggtatgtagcaagagctacctgtgctgctattgtgaattttgctattgttattattacaagtgctactgctgctcgttgttttgaaaactaacatttaaaactcttcaaaaagcgaaagtgaatctcaccaccaaatctgtttatttggtttgtggctatgagctaaatgatgttctaaatacactggagagagacacagcccctgcctggggccattgtaatatctgagatgtggaagccctttgtcttattaagctcacgtatgaaatcctagcatggggccagtcactgaaagccctggaagcaggcttaaattcttgttaaaagaatttaacaagacactgtctctggtgtcccacatcacatcccctcagctcacccctcattttagccactgctgtggtgggcagtgctgtggcagctcagactcaccttatacatatagtgcctgcctcggggttacttcaattatctttctgcttcaaggcctttttcaacactgactgagtgtgcttagcctgtgtgtaagggcagccccaatgcaaccttcaccaatggagataaagactggtaggtaaattatgcagcccctcatcctccaggtagatgattctagaaagtgttccacatgcttctcagtggctctgtggattctcaggaacccctgacgcctgcaacagaggccttcaaaacacatccattaattgattttgaaccttaattgtatcactctctctgctccttcgctcctgtctcctagaatcacctttcaggtccttgtctcaggctctgatttctggggacccaaagtaagacataaactgctccaaaaccctactgatcaaaccgatgtctttgtgcaaatctactgtaaactccatttgtcctgttccatgctgcctccccagtgcctaccacagcatctggccacccgtaagcattggcaaatgctagctgaatgatggagtccatgagtgaattaataaacatgcttcctggaacttgataatgagaagatcagtagggtactgctcaattgtacttactaaatgtggcaccagcaatgtggtaaaggatgtcaaaatcttccttggagggctcttatatcttgccagattacatctatctttggtcctggcaagtattcaattttcccccaaaatcttgaagagaaaaagttggcaaatttgttgattctctatcttttcaaaaatgtatatattccaaacatataaatgttttataagtcagctacaatcattgatcctgttatgggcccaccccaggtttggacaatagatgagggtgaactatttggtacacacctttcaagagggagcttatggaaagatgcacagttaacattacatcatggggcaatatttgggcacaataagggaagctggtatcagaggcacatcatgttatgtggacattcaattggccacacattttacttgcaaacgtaacaacacaacaggcctcctaggctgacttgagaatgtgggatgctctttcaatgtgtggacacatacccgctttcaatacacaaaggtgatctgcacgacctcttcaaggcaatgggttcgtaatttcatcttttctagaggaaaagacttaaggtttagagcatttaatctgcagaatctgatgaactcaaggtttccagatactgattgagaagaattgatgttactatgtagcctgaaaagataaaatgcatacactagagcttcactgccagaacaattagtggaaactgtaaactcatgaataatcttagctgacttttgactcaatcagaacacaagcaaaattcaccaatccaaattatggagttcctgagcaagtctgcctcctcttggtcactgaaaaggagggggaggtctgtatagataaactttaaaaagagaatgagtcttgtttaatgactaataataaaacgttaaggtcattggcaatgtgtgagagagagaaaatggacaaagggcggaatattttaattaaactacctaaaagagactaaagtgaacagcactaatgactcaaccttgctgccagtaaagcttttgtctaatatcttgctagctttcaagctgtttttggttataatgttgtaatgttgtttggttataatgttgtataatacattgagtaggtcttgaagattttggctaatgggtttgggtgaaacatggcacggctgctgctgttgtggacaaaggtgacagtgatcatgatggtagtggtggtagtgatggtagcagtggatgatagtggtggtggtggtgtgatgatggtcgtggtggtgatgctgatgacagtggtggtggtggtgtgatgatggtggtggtggtggtgtgatgatggtggtggtggtgatgctgatggcagtggtggtggtggcggtggtgatgatggtagcggtggtgatgctgatggcagtggtgatggtggtggtggtgatgctgatggcagtggtggtggtggtggtgatggtggtggtgatgctgatagcagtggtggtggtggttgtggtgatgattatggtggtggtgatgctgatggcagtggtggtggtggttgtggtgatgcttatggcactggtagtggtggtgatgatgctaatggaagtggtgatggtggtggtgatgatgatggtattggtaataataatgataactagtgtttattatggttcggaagctctacctctccctgagtcctcataaagagtcactgatgtagggtaggtatcattattatcataattgctattcaggttttaaaactgaaagaacaagcttataggggtcacaccattaatgatcagtggagccaagactcagactcaggcaggctttctccagaggctacacacttaactccatgtagtctttatactaatctaacatcttgcatcccattttaaactcatcatgattagaggccatccaaattcagttctaagcaagaccatacatcccgctgctaagggactttagagtgtgataaataggaaattgttcacagatcctgaggttaatggctatgaggcaggactccaaccacaactttattagccaggcaacaatttcattaagtagacaagtaactcacaaggggactatgaacaagctgatgttgtgttttaaaggtcaaaaactgatttcctgtagatttaactaaggcaagaataaggtgtgattttaaatcagaagctttatttgtagttagagcagacttccccaccaaaacatgcagaactgttgcacctgattgtctgccaaattcttatgattggtcctctctgctcttctccccacctgatgcaatgtggatatgctctgtggagaggaaatatttggtacttaaagcaggactctgggaatcatttagccatcagcaactaagtccttatgtctcactgggattccaatttttctcttattactcaggctcagcgagttaactccaaactgagtgcttccaggaaacaaagaagaaagagagaaaaggaagcctttactcaaaactgatttctagaacaaggtagtgctcctagatgaaatgaaaatttcagcttttatcctctgtcatttaaactggactagacgtaaaattacctcagtaggtcatttctctaaataaaaatcccaacttctacaaatgatattatacaaagtgacaagctagtctaaacatttcataggggctccccatttgtcaggagttgggctaagtacttgactggtgttgtcccatttaatactcatgacaaatctaagggcgagtggggcaggagggggtttgttgtcttctgtctggtacagataagttagccagaaatcagagaggttaagcagtttgcctaacatcagacagctggtaagtggtaaagccaggatgtaaaccttgtgactgtcttttctgttctccgctgctacttgtggttcgaattagaatagaagccacacaagttgaaggaatgctacacccaatcccagcatttaaaaagagctgtattgtataaaggtgagaagtacactttttggttacacatctgttggatgaactactgcaagatactcaatctcttcaagctccagttttctcatctgttaaatggggatcatcattactacctcacaggtttcttgtgtaggttaagggagaaaacatttccaaggtgtctttcataagcatccctttccattttattctgagaccaatgccttatgtcttggacctaggcaagatgctggttccataacatgataattgttcttcaaagcatggataattatacgttacatattataacatattatgtatatattttttccttgatggaaaattttcaattttaaaattcaaaagaccttgtgaaagatctcctggtgtgtctcaataatagtctttctcatctctgtaatacagtgtttgacatactgggttccatgggaatcgtaaccacatggcctgaaagaaaaaagttccttcttgaagtaagtttgagaaatatagcagacttgttttccttgttcctttccttgttattttcttattcattgaagactctcatacatgttagctcattaaaggctctgataagtcctgcaatgtagaagcctatatgtgtctttgactataaaacactaattttcacacttctttgagcaaaattttatacacaggtttcagtttggaaactggcacaaagccttaaaggtttttattttatttaatattaattaattaacttctcatgacaaccctgccaggaaaaccgggcaggcattgccctggaatgaagagcccaaagggtatccgtgaaggtaaagaattagtggacagcattgcagccattcatttaagaagctagggctggaagaaaactacctaaaattattttttgaattactttttaacataacccattaactttttaattatttaattccaagaattttaggcactagagcagtttgctgcggacatttggggcagtggagcctttgggtaaaaggcaaatgtggttctttctccaagatacagctctgaccctttcatttatttccatttttgctgctaccacactcaaccaaacctcccaggcttccacagcagtctcccaattagtttcctgtttctcatctaattccattgaataccatttctccacccagtaatcaaattactctccacagcacagcactgtgctccctttcttacaaccttctaaaagcttctcttttcttagaataaaatgccaagtttgtgccactgcctacaaagccctttctgtctggttcttttccacttctccaacttttttctcatcttacgttcccctcctgctacattccagttacatttcccttcctcgagaacatcagactattttctgcctcaggacctttgcacctctggatccatctgcctgaaagcctcccttctcaccagcagtttgtaggaatggctccttcccatcctggacacctttgctcaaatattacctttccgttagctacctccctgtcctccctggctagagtcttcttatccttttctagctcattgcactgtctctttccttgttattttcttgttcattcattggtgggtgtgtctgtggtctgcctccccagtgtcaaagacaagctccacgaaaacagggagctttttcgacttcaccatttcatccttagtaactggataatgcatggcatatagtgggctcttattaaatattttaggaaataagcacataaggaatgagtgaattggtgagttatgttgtcccagagagattgcctgcaccatatataactagtcatgcatgtgacctttgaaaccatagctagtaatggctattttttgcacttatcagtgactctattataattcctctcagatcccatattttcccatgatctgggtaacgtgtaataccctcttgccataatcatctctgaacacacagacacacgcacacgcacgcacacacacacataagaggagagctggtctctaaggtgctgtcagagctgtttaggctggccaattagttggcttttgttctccccagagggaagaagagcaccgtttaattaccttcaagtattacccttcctgcatccttatttttatttttagactccccactgccatgcttcagctcttcttcaaactgctactgtccttattagtgctgctcccaagtagattaagcaaactttttagctgttgctgtgagctcttacatccacaaagaataagcccagaccttagctactgagcaggcagaggcagatgctctgtgagccctgctgcagaggggctgggctgcatacagccatcagcgttcaaggctcatgccttacaatcactgtagtatcctggctggagttcagcttttagagcccaagagcctcgctgggaatcctggctctgccatttagcagacgtagaatggggtatattgcttagtttctgtgtctcagcttttttacctgtgaaataggaatgatcatagaaactccctattttttaaccttttttttttattattatgctttaagttctgggatacatgtacatgcaggtttgttacataggtatacacgtgccatggtggtttgctgcactcatcaacccgtcatctacattaggtatttctcctaatgctatccctcctctagcccctcatcccccggacaggcccaagtgtgtgatgttcctctctctgtgtccatgtgttctcattgttcaccttccacttatgagtgagaacaagtggtgtttggttttctgtttctgtgttagtttgctgagaatgatggtttccagcttcatccatgtccctgcaaaggacatgaactcatcctttttatggctgcatagtattccgtggtgtatatgtaccacattttctttatccagtatatcattgacggacatttgggttggttccaagtctttgctattgtgaacagtgctgcaataaacatatgtgtgcatgtgtctttatagtagaatgatttctaatcctttgagtatacccagtaatgggattgctgggtcaaatggtatttctggttctagatccttgaggaatcaccacactgtcttccacaatggttgaactaatttacactcccaccaacagagtaaagtgttcctatttctccacatcctctccagcatctgttgtttcctatttcttaatgatcaccattctaactggcgtgagatggtatctcactgtggttttgatttacatttctcttatgaccagtgatgatgagctttttttcatatatttgttggtggcataaatgtcttcttttgagaagtgtctgttcatattctttgcccactttttgatggggtcatttgtttttttcttgtaaatttgtttaagttctttgtagattctggatattagccctttttctgatggatagattagaaaacttttctcccattctgtaggtcacctgttcatgctgatgataatttattttgctgtgcaaagctctttagtttaattagatcccatttgtcaattttggcttttgttgccattgcttttggtgttttagtctttgctcatgcctatgtcctgaatggtattgcctaggttttctgctagggtttttatagttttaggtctcatgtgtaagcctttaatccatcttgagttaatttttgtacaaggtgtaaggaaggggtccagtttcagttttctgcatatggctagccacttttcccaacaccatttatgaaacagggaatccttcctccttgcttgtttttgtcaggtttgtcaaagatcagatggttgcagatgtatgttgttagttctgaggcctctgttctgttccattggtctatatatctcttttggtaccggtaccatgctgttttggttactgtaaccttacagtatagtttgaagtcaggtagcatgatgcttccagctttgttctttttgcttacaattatcttggctatatgggctcttttttggttccatatgaaatttaaagtagttttttctagttctgtgaagaaagtcaatggtagcttgatgaggatagcattgaatctgtacattactttgggcagtatggccattttcacaatatttattcttctgatccatgaacatggaatgtttttccatttgtttgtgtcctgtcttatttcctcaagcagtggtttgtagttctccttgaagaggtccttcacatcccttgtaagttggattcctaggtattttattctctttttagcaattgtgaatgggagttcactcatgatttggctctctgtttgcctcttattggtgtataggaatgcttttggtttttgcacattgattttgtatccaaaccccaaaggcaaacaaccaagctgccctcactaacaaaagcttactagatattagggagcatggcagtccatggatgccaaagtggcagaggacacagtctttgccctcaaaaaccttagaaacttgctgaggggacataatatccatatgagaaaagggtagttctaaataaagatacaattaattggacagagagttaaagaaagagggactcacaaaagatgaagatatttctgaggtcataatggtcaggactggacccttgaaaagtgtgggagttggactggacctcagagtagagataggattcagctgaaatgacaagtgtgatgacaactggaaaaaaaaaaaaaaaacaatgagaaaaaaaaaacaatgattgattcattggagtcgttggctagagaggaaagccttctagaatggcctgtgcaaaagggaagagtgaatatgcaaagtgggcacaagagtggaagggagattggagatttgatagtgaatggattcaatgttctgaaggtgaacaaggacacagtgagttctgaaaggaaaagaggttaaatcaggagaccaacgctcaagtcacattcaaattcttaataggataagtttctcaaagtactgagtgcgtgtgtgtgtgtgtgtatacatattatatatatacacgtacatatggttgtttctttgccaactgtaattatttaaagatccgtatagctcctttgttagccactgacatttagacaaacaaatttaattttgggttcttgttttcttcaggttgaggaacagctggttcttactgtcagtcagtgtcagtggcctgctggaatctgtccaggatacattttcttatagttagaatatttaagttgggtttagctttaaaaaaagctgacatccagaaagttagactttgctcagtgcttcttctaaaatggccactgtgtcaagtaaacaaatacctatcgactccatgctatttgtctggaaaaattctagatgctggggagatattaaaaggaaatataagagatagggtctctagcctccaggaggttactgtcattgggaaggtaaggacatgaatcagttcccttttctttcttattcaaacaatatgtaagtttctgttgaaactagttttggcttcatttaaaagaaaccccaaataatagtggcttaaataagatagaagttaatttttcttttacgtaacatgatgcttgaacttcaagcactgtctttaggcatgcaaaatttcttagtatgtgatttctatcttctggcttgctttgtgattatgacttattgctcatttttcagccattagtggctagggaggtggtgttccagattggaagaacaaggcagggggagaagcaaaaaggtctcatttcagccaagtaagactcttttaaaaagctttgctgaattacttacattccactggccacacatatctgtcagagagcctggaaaatgcagttttttaactgggcacattgccacctgttagtaaagaggaagggaaaatcgatttcaggtagtcatcaaacaacatctactgtaatacatctccaggtagctagctctggccaaacaaagcctataatttcttctttgacattgtcccaggactcagtggtagggcaggcacatgctttgcatatctgagatcctgcatgtgaatttgggaatttcctgatttccaggcagcatggaaaaagaagcacacactctagagtctacaagacccaggttcaaacccccaggttggctctagcacaatagaattaacttggcaagttgcatagcagctccaagcctctattttcttgcttgtaaaccaccatctcatagggttgctttgaggattaacgaaaatacctagccttgtgcttgtaatacaatagatgcttaagaaatatcagcggtattttttgtatgctcaaagttggaagttgatcctttaaggattaaaccattttggctttccgaatagcagtttatttaaacagctgttactgaatgacaatagccattttttcatttgttttaatttatcaaaatttccctttttcttttacatttaaacaatggtagatatgatgccagatgtatgtttcacacatatttggggggaggtgaatcttatgtgcatataaatgtatttcttttcattaaaaccggggaaattttgctgaagtctaatgaacaagcctaaatttacttacatatgcttaagtagttctcagccagcagagaaaaacagattgaatttcagaaagattgacttgcacatattcttctgattttgactcatagctcatttcaagtatgagggcaaatagaatagttttctttttatcagtcaattaccagtcaaaattcttctgattttgactgatagcctagtttcaagaatgagggcaaactaaggcaacacatgatagacctatatttccttcacactggcagaggtcaggagtcagaattctataagtttaaaccaatataagcaacccgaaaacagaaatgctatataggaggagaaaaggctttcaacaaagcattgtcattagggttcggttaaatatgcatgcatttgaaatatacattgacttaaatgcaaatagtcaggctgaagctctgctgtaaagtaaaggtacacccacaaaaggacagagccttttctggagaccagcagaaatgtggttgtatttatattagtggggacagaaattatgatcgctctggggccgctgcagcctttctgctgacaagttgcatgccactgttccgtagtgactgttctttacctggaacggcttctccatggcaaccccaaccccttcacagggcgcattcgttgcttctctctttttaaaatgaacacattgggaaggaagtggaatatgtgtgtttgagttcctaaatggaaaaagggagggagtaacagacaccagggaaagcgcagaggatttttttttccttttgcttaatttgcatcctacttccatggatatgggtcaaaaagaaatgattaaaattcactttgtgcattggattctctcttccatcagtgtacatcttggagagacatggtttggatcaattaatctgtattgcagttgataccaagttttagcccagtggtttgctgcaatttcaaaggatacttcagtgttctttttacctattcattaaggactgtcagcagccactcagacccaaaggatttggctgagggaaaaatctcagaataatttttcaagaatataagtttttaaaagagaagactgaaagcaccagaatgatttttctattatgtctgaggaatattgttttctaaactctttgctcaagatccagaaataggagtactttatgggaaaaatctctctcctgttgtcatggaataagttaagagactcctctaaacagaaaaacaaagcaaaacaaaaaaacctcaagcattcagtcacttcaaactatttcatatagatgtcctgctttttttttttcttttagttcccaaaggttctattttttgttgttctttcaattttataattaaatgaaagagcaagccttgacaagtgttgacctcccttcaatgttttggctttcttaaataatttatcccattggattatattcagaaaatgagagtttgactttaagctgagaaagtatgttctaaattgcagcatacctgtgagtaacagcagcagtaagaagtgggaccgtgcaatactgcatgatagaaagttctagaaacttgataggttcctggagtacagaaaacacaaatgaaactaagactagtaaatgtatagatgcagaggttttcccactctgaaatcttacctctaggtttgagtgaagtagaaacagataaaaggaaagattcctatcacacaagtcattgccttcatatggacgtcctttgaacctgtggttgtgttggtcagctgtggccagaaagtgaaccataaacagtaaatcacaagaggcctgtaaggaaaggcccagataggtcatcttcacgtctggctggcacttaaacttggccttttcccataaaaactgttgagagaaaaatagcaatgttatgctagtagccctaaagcacgaaagatgtccaaatccatgccttgctactccacagttacctttatgaaaagtattttcttatagccaaatatcccaattctttgttaccacacatgactaatcttcgctactatttaaaaaaaaaaaaaagtggattcaatgagtagatatttacttcccgaaaattagggcaaagaatttgaaaatgcctaatggaatatatttgtatatacctaaggtgagaaagcagcccattaggtctcttcctacttaacaatcatcgagagtttcatagtagagacatttgctgctcagtgaatatccatgttttcccccatattcttcagcctctctggagttgagcagagccatgtgacaagaagtggccaagagtagaactgatgtgctatttgtaggctgaagcatttaagagctagtgcaagatcccttcagattttaggtgcctcaccacgagaaacatgttgacatggtgtagcaacaaggcaaaagtcaccaggagcactgcaatgaatacagagctctaggaaagtaacatattgtacatcaggttttgtggcttatgtttagtcaaagattctgggattgtctgttaccacagcacagcttcttctatcctaataaacacgaaatgtttgttatcaaggctgaatttctttagccattttgtttagtttatgtaaaaggtggtggagcaatttttaaaactgtgagctttggaattaagcagagatggattagaatcctaactccaccacttatgagctgatggaacatgagacaagttatttactatcttggcctctgtttcctcatgtataagatggaaactccgtctacatgagcagtttatataaaataactagtataaagcacttagcacagaactgagcacatggtgtgtattcagtaatactggaagttgcccttgctgtttgctactcttgatagttggttttcataacagtgaggttgcctttagtaagggactaaatcattacaagtcttttcagggtagagttaggatatgtttgacattactggaagttgccaggagtagtgaaactgaggctctatgggcctctgtcaaagggagaaactaagaatgaaccagcatatcgacagttcctctgctttgttaattactgcccttgagtgtgaccatgtagaaacaggcagattgtttttgtcctatattttagatgtgcattgatgtgcctttggaattctggaaacaccaacatactctaattaagaaaattccattaggaaatgaatttctactgcattgttatatccatcattatatacataatatttatttatgttatctcttgcaaacattgacataccgaatatcaggtcaattaactttagaaagtaattgtgtatttaaatagcagtaagaggagaaatacacaccactggaagttagagttgggaataggttccgtagagtgaacactgtttcaataatatgtaggaatgaataattccccacctaacaccaatgtaataatgtactgtaagcattgcttttctctgtataatttcccaagaattcaatggaaaacaagtaacattatggggaaatattgattcactttgggcacagtgggtcttgttataataaagacagagtctgtggccatttctttccttattctcttctttaaaaaaagaagtaaatatatggaattgctaattataattgggacacttagattgcttccttttatagaatgaactaggagatttcttgggcctcagcaattttttcgtgacttgaataccctaagggcatgaaaaagttaagatcatgtaattatgccagctttagtttttgcattttgattaagccttgagtttgttacaggaatcccaagcaatcaataacaagcctcatcttacttatctgaactcatctcctgctctatttcaacccatgtcaatgtgggaaactgagaatacagtggttaagagtacaagttgtttattattggctggctctatggcttactagctgtatgtgatattgggtaatgtcaaagaacctgttttgttatcgacaaaatggagataataatagtacctcatggagtggttgttaagactaaatgaaatactggagtgagactctaaatatgtcaataaatagtagatgtcacccaagttggctttcctgtggttcgttgtgctcagtttcactcttgcatctcaaactgcagtgaagaatacatagtgggttaattgaggtggcctcagttaatatgaggttttagcctgtcatatcatctattcacagcctatgtgggaggctaatttggtgacaacagcacttgaggttggttatcaaagttgattcagaaaatacagcaggctttggggccgatgcctttcttcacttactgcatataaaggtgatctgctcccaaaactccgaaggaaggagcttgggcatttttcagaggtggctgagtatgatgctctcttactagaatctgaaaacaaacctcctcttctggaaagattaagctactgcattttccaatgaggaatcatacgttttcctcctcagtcatcttggatgatatcctctacatttggactatacatttctaaaagaggaagtgcatgtattaccaactcttctcccactgcaaacattttttgagtgcctaccctgcatgagtcctgggctgaacactttcctgccacttacttgacttccaactttgatcaagttcctaaacttcttgtgccaccatctgtaaaatgaaggcaatgatggctacctcatggagttgggtatgagaattcagtgcattaaagcacataaagcactaagactaggacacattgaaggtactcagtggcaatagtcagtattaaacttatctctaatttatagaagagcaaatggtctcatgggagttgaataatttgcccagggctttagagcccactatacctaccttcaaaatcttggcatttagcccctttactgccctgctgcttcctatcattcactctatacaactaggaatcccaggtgctctgctgtctttaaaaccatgtataatttgttaaagtgacttcaatgagcttaaaaagaaacataccaaacctgagttagagaatgacatggcagaaattttctagaatgaatacaaatttctgcttgcctatgaggttgtcagactgaatttatacttaaagtactgtacctaagctagtctccccttctggcattaataacctcagctctttggagtctaagaataaccaaacgggtgccacgggtcaatggtgggcagcagcttgtgagaatctacttttctcatgtagccaaactgctgcacaagaaataagcaacatttatgtggcccctatgtctaaggtggacacttctttaatgagatgtatatacctcacaagaatctcctttcagcccagctatacataatatactcacagttccaggccttgttcacctcaattccataatcatcctcattatatgacaggagagaaagaagtagacaaaccctttattaagagagagaactcaggtcgtcagcaagtgcagtggatgcttctgtttttgtctaactgacttctgtctctccttttattgataactcctctgcccttacaatctacccagttctggtgggatgcccactgcccaactagacacatgacctaggcctgatcaaatcagactaaatcctaatacctataccagagttattgagaaagataagttttggtctgctggccttgacagtgaaaggatgtaggcttggagctcctcagggccactgcttcagggaaccttgctgacagtgaagccaacacagaagaaagcaaggccaaacattgaaagagatagagtcctgattcttccttttgaacaattggataccacctggcttgaagctttccactgcgcttctcatctctgataagggttgacaggtgtcttcctatttattccttaaggcagctttggttaacttcagtcatctgccactgaaaagaaccagttcagcaaattttatccccattctaagatgttctccctcccaggtcacttttagtttcttgtgagcacttggcatgttgtgaatctccatcagtaatctctgaagaatctgaagttaccaaactccttgacttttggcttctgcccttttacctctagcttagcggagttacctagatcccacatggcatattggggaaagataaaaaagaagagagattatctccagggtagttttgttccatacatgaggaaatgctaataactaatgaaaaaaattgctttgtttctcattcaagcttctctaaatatccaaaggaaaatgttaatataaatctctattgcatatgggaaaagtgaaacttggagaagttaaagtgcccaagatcacacagttagtagctggtataactaggattcaaaaccatgcgtcttatttgcatgtgatggaaaggcaagctgggaacctgtaaccttctgcattaaaggacgcctttcatccaaaccccctgtgctttagtgtggcgcccagagctcctccttcaattctgtttccatggtgcactgtgcatgtgcagtccttgaacgttcttgcatttgctgggggtgggaagcctttctccaggtctcagcttcagatgctgcccacccagccatctgtggcaacagatttgtgtgttatcaattaaagtctaaaggaagttggcaaaacctcctactctaacagggtgggctaaagaagttcctgttaaaacagaaatggattgtgtctatgatagtggtagttggtagctttccaagagcactttaaatacaccccatgccttgaattgctcagctctgaatctctttaagatattcctctcagaggcagctcatttccatggagcagaccggtgcataattaaacagggttgcccttctggaaagcaaagcaacattcacaatttggagaatctgctcctgtgattttcactttgtgactcacgtgggaaatcgttattttttttttttagtgtacaaaatcttcatatatataacatgtcgtgccccacttacagtcacaaaaccttcttggtttcgattgctctggaagactctttaagatgcctcacctagggaactccaaaatatcaagtacacaaaatggcctttaagttcaagacagaaaatctcaagtacatattccttatttagtgaaaatccatcttgctatttttacataactagatgacttaaagttttagatagagaaatataaaacattttaaatacctactatgtgctattccctgtggtaggtcctggaagaatagagattaaccatatatagtttctaccctcatggcacttactgtctaatagctaaatagggatttatgacagtctggccacacatacaaaaaatgggtactacattggcttatgaagaattatgattctgaatcataagaaatttagtcccattacaggataggcccttgtattcttaaacatcacattatccatccttctactaacactctgacagcaatatacaaagcacaatggtctccctttctctcttttgtaaaatttatcaacttcagcatatttactttggggccagataattccttgtcgtggggactgttgtgtccattgtagggttcttagcatcatacttggcctcaacctaccagatgccagttatgacatccccagttatgacaaccagaagagtcttcggacatggccaagtgttccttgggtggggaagagagtgggaaaaatcacccctggttgagagccactgagccaaaccaagagtaacagtagttgttttacagcttccctaaaacagaatgaatcttgttttaaattaatagagaaagatgggtcattcctggagacaaaggaatgcactaaatgacctcctaagatccctgccaatcctagaattccagggtacttttacccataacctagtttggttcctctgtgtccctgtccccgtggaccctcatgactgtgcctgacaggcagctgcatatccaacatgctctttatgtcagcaggaaccctggaggagtcttttttttttttctttttttaagttctttttgtttttgagaaaacttggcagaaacattctttttgaaagaggaaaaaaagaaaaccctaaaaacaaatttaagggccgtgggaaaataactttctgtgctcctaggtaccaggaccgaccatttgttagtatcgagcatctgctaaagtgtgaaaaattcttggaaggcattttctaaattttgttattgttgttttatccatttatttctatgagccctttcctttgctgtatgttgcctgtccatgttgggctggccaactgaggtatgcactgtcctttattttgaagaacatactatttatctgatggttgggaaggtggccgtactgaagtataaggagcccagcatttgaatgttttaagacctgacttttaatcttatgaccatcacttcctgactttgagatctcaggacttctgtgctttaattcgtacttaaaaacgtggatggtaaaactctccactgaacagctgtggggacaaaacaagatggtagctatttgtagatttcaaaattgctatgaaaattatttgttaatatgattggacattgtaatcatgtagcaaatgtttgtttccccattggctacttatgtagggtttatttaaaattaggcaaaactaagaatatgtttcctggccacaccttttatatcaatctctcttcaaatgtgatccctggactcttctttaatttcccacttcagtagtccgtcttacaatttttttaacctagtttttctgtagtaaaagtgcagttttcagagttcaacttagggtcaaatcccagcttctgcttcttttaactccatgctctttgacttttaacctgagcacaatgtcttttacatttacattccatttcctcatcaaaaaattggagataataataggtcatatcttagagagttgttgtgatgataatataaaataatgactataaagtggcatcaagatgcctaggcccggagaccggccgtgaagatgccagtggcggtgatggcagaaagcgcctttagtttcaaaaagttgctggatcagtgcgagaaccaggagctcgaggcccctggaggaattgctacacccccagtgtatggtcagcgtctagctttatgtttgctccgtaatgacatgaataatgcaagatatctttggaaaagaataccacctgctacaaaatctgcaaattctgaacttgggggaatttggtcagtaggacgaagagtctggcagagagatttccctgggatctatacaaccatcaacgctcatcagtggtctgagacagtccagccaattatggaagcacttagagatgcaacaaggagacgcacctttgccctggtctctcaagcatatacttcaatcatcactgatgattttgcagcctttgttggacttcctatagaagaggctgtgaaaggcttattagaacaaggatggcaagttgattccaccacaagaatggttctgcccagaaagccagttgcaggggccctggatgtttcctttaacaagtttattcccttatcagagcctgctccacttcccccaatacccaatgaacagcagttagccagactgacggattatgtggctttccttgaagactgacttatcactctgagttcaagattcatcttcagaatcctgtatactgacaaatatagaaatgtaaagtttgtattttcaatttattggatggcttaagcacctcagcattccttactatgtgataaaatacatatagaataaaaagaaaaaagatgcctaggccctatgaagtacacaaaaagtattaacttgtactgataaacttgaattcataaagctcctggacaaaattgacgtaaaaagccttcatctttcaaagggtatagcctccattttgaaacaatttctttggtttacacaacccgggggacatggtccacctcatgttctctatcactgccctccctgtccctcaagcttgtgcaaccacaaccctggattttatcagttttttccatagaatgttaaagattttctacagaaggaacctctgttgatacattggtagaagtttcctcaaagtcagaatgatggaactttggaagagcttgagaaaaactggggtattagagcactgcttcttaaactttaacatgcgtatgactgccttggaatcctgtcaaaatgcagattctggttgagtgggtctaagatgggggaccctgagattctgccattcctaacaagctcccaggggttctgttgaggctggcgtagggaccacactttgtgtagcaaggtgtagatgaggaagtttgtctttatctcatctatctttagatgccgtctttctccttaagaggtgcctttgactcttgataaagcttagatcccaccaaaactttcctcctcctctcccagcgttcagaggctagtgtggaacaagaatctcaggagatgttcaacacccaaaggactgtggaataaaaataagtttgccaaacaccatgaaccatagttccccatcttggggacccacataatgcatggatgtattaaaggctctgaaaagtcctgctattttttaaaaaacatgtttcttatggtttactctagaattccccttaagtaatctacaaatatcttaagactagattagaatctcatgggtggaacccagatttcagtagttctttaactcttcctgggtgatcccaatttataactgaggttgagaggtctgccagggtaagcataggaaattctaacagaatacacttggggaaaatcctacagctaaaatagctcatctaataacattgtttattagatgctaaaggtgataatttctgaagtggtaagcctacctttatacaatagatttcttatttgaaaagacttaaatggcttaaatcaggctggaaatttggagatgctggagctgatggatttagtggaaagagagaacaaggactttaaaatacctcttgtgtgtgtatatatatatgtgtgtgtgtgtgtgtgtgtatatatatatatatatattctatatataatgatgtgttggcatcttaaaaagaaacaaaaactttctagctggggagagactgcctgtcctagagctaattggttcttagtggactcagccaggagcatacccttgttatggaaactaagtaatcctgagccatacctccttaacctggcccatatacccagaaggcaacattcctctgctttaaccactccagggccaggtatcaggcaactagggaccactcttatagtttagagccagccaaattatccaaaatagttgatcttcaatagtttacccgcccctgcctctcccaagaaaactccaaaaaaggctgcaaaatatccccccctcccaactttctgctcctgcctctgcctcttgtccagcctagtgtctctcccatgtggcctcatgcaacgtgccatgccttcgatctctagggccacttaatatgttaagctcgctttcctgagcctctcctgtctcctctagtggccccacctgattgaccatcacataaaagaatatgaaacactcctcaaaaccacccatggcattgaatgcatgtctctatctgtgtctaccaccggctccaaccagagacaattttctgaaacacttgaaagatttgagggcaaaacattttttttgtagctctattgaacgtgaattccatctctggctctttcttccgcttaatgataggctttgagcaaagacattgaacttctctagatgtcctgatccttgtgtataaaacagggctcacacctgccctgcctacctttcagacttattgtaagcattaaatgtggcagagaaaacacacttggtaaaatgatgtgccaaacacatataaaatataacattattgttgtgagagaaaaatgttgcctcaatttctgagaaataaatcaattatttggtgcctttgattatatgctacagaaatttgagaaaaagcaggactctgcttctgccaatgttcttgtctttgacctctgctcagagtctcagtgctaattggttctgtgtagaagaggcaggagaaactttgttacctagtttgtctaattaatagccacagatcaatttgcttgtcattttttctctcatagattacttgttgttttttgactaatgggtcctatctgaagatggctacatattgtgccacaaatttgtcctacctctggtaaacatatgaccttttgaactatttgacgtagcatagcagtctgtattttgcaagaagccttatgtatttaacctccttctctcatatcattttgcatgaatgtattctgcctgcagaggcccttataaatgggcaataagctttgacatgtgttcagatcagtttggctcagaaagtttattttaaatttactatacattttcattgtcttgtcttccaaaattccagtgatggtaattgtaacagttcacaccaggcccttgatctcatctgtgcaatgacaggtgtttgagaaagttcgttctgggaatgtcagagagacttcagaaaagcgtttggcctgtgtctgtgtagcttctcagcgctgtctttgtcacattccgtgctgtgttcagccttcctcccaactccggcagctttccaaagcagcctcctgattcatcctcatcaagcagcagagaagcccaggtgcagctctgctcagccttctttggggaggcagagctaagggttatccccccaaggcacaggacatccctttatacagggattttttatcaagattaaatttattcaagtacaagatgctttgtaaaaatccagtccccaataatatctacatcactctgaaatggaatatagaataccaaaatgaatttctttttcaaagaagtgataagctgccttggatgtatacataaaagaaatttttaaatgattagcaatattattttattctgcctattttagatacaactgctgctattattatgtctactactgactgtaatactgagtgtacctggaagtaagttaagctgtttgcacacattatctcattccatcctcctgatgaccatatgtagtaagcaacgttttttacccccaacttatggttaagaaaactgaagcttggagatattaatagttaaattttccctaagtgcttacttggggtgagccattacactagtcactttacctgtatgaggtcaattaatcttaattaactaaagtaaatgtagaaactctgttagtcactaaggctatcccatttcacagataaataaattgaaatgaaggcacaaggtctatcttagtctattttgtgttgctatacaggaatacctgagactgggtaatttataaagaaaaaaagcttatttggctcacagttctgcagaatgtacaagaagcatggcaccaacatctgcttctgatgagggtctcaaggagcttccactcatggctgaagacaaaggggatccagtgtgtggagacagagatcccatggcaagagaggaagtaagagagaggggtgtcaggctgtagtttacagccagctgttgtgggaatgaatagagcaagaactcattcattacaacaaggatggtaccaagcctgccaggagggatttgtccccatgacccaaacacctcggattagactccacctccagctttgggataaaatttcaacatgatatttgggaggacaaacttcaaaactttagcagagtcttaagaaacttacctcaggattctagatttaggaagcaatgtcaaaagaagacctagcacgtgtgtttctaaaggttgtgtgcaaactctttcttctattgacaaggaaatagaagttagaggcataggagatggagctgggggctgggttgtctgcaatactttcttcctttatcttaaggtccacctccacctgaaaagctgtatttatttcatttgagatactgcataggtaatgaagcaaggtctcttgtgctgagaggcaaatactgtaatcatctgcatgacttgattctttatttcagtaatatgaaaattgtcaaattatggatgaattatggatgctacagatacctgtaatttgctgctgcagttttgtaaacacatgcagctgcctttaattttgttttaccagtcatgtaattcattaacacacacctgcagtttcctaagatacaaagacgaatgaagctggtttgcagttcccactctttgtgtttcctacacttctctgtttaatcaccacactcagaggttgagtaattggttaaaaataaatgcatctcaaggaggagcctggtgattatccttgaagaacatgctcaaattcccacctcagccattgacttaaatcattgttttatcagccaaagcccagggcagtttggaaattaagaaatttgtagaattgattttcattttttgcaactgttatggcaacaaaggcaaatcattaaaaaatggattttggagatagctgttggagactccttaacatgagagccatgactggtactagtgggttcttgctgcttcaccaagaggagtgttaaccaaggcctcatctgagaaatgaggtgttgcaagatggtactggcaggaagtacatgttttaacccttcatttacttctttctttctttcccgcctattgaaattgatgagttaggttatttttgattgcttcctctcctcactgtcatgcctgtaaaaaattttaaaatgtttcttttcagaaaaaaaaattctcatttttgccagcttttaaaaaacaagatcttcagtaaaaccataataagaaataacagtaatagctacttttgttgagcattagccctatggctagcactttattaagagtgttgcacagtcaatttgttgagtcctcaacacaacctaataacattggctttattttcctcaatttatacactagaaactagaaactaaaaaactaagtgacttgctgacatggggcctctatgacttaaactcaggatggccatcctgagtttattcaaactcaggatgttgtatttcacataacaatgccacatagacttatacctcacacagctatcctcttgattccctctacacctttcaccattaacattctcctttgtatagccataactgttacacaagctgcaacatattttgtaatactatgccagttccattgctttactcacttatgtatttaagctattgttatttaatgtacaaaaatgttcagtgtgaaggctaaaattatattgacaatgtcctaagtggctttaggcaagattataaagtaaggcaggcagcttttcttgatattttcctgtcctttgtataccagaacatttattaggctaaatatcttagtttgctttgtgttgctgtaatagaatacaccagacttagtaattcatacagaaaagaaatttcttgctcacagttctggaggctgggaagtccaatatcaaggttccaggcaagggagggcctttgtgctgagtcataccatggtggaaggtggaagggcaaaaaagcttgagaactgagaaaagggaaccaaactcacgattttcatcagcaactgactccagcaataactaacccacacctaagataattaacccccttctgtgataatgacatttattcatttataaggacagatcccttatgatgtaatcaccataatcaacaccgttgcattagggattaagtttccatcacatgaactttggggaacacattcaaactatggaactgaggaatatagcctgcttcccctgttctacaccaaaacttatacattctatgtctcattgctacaaaatcttatatgctactggattctaattagcaatgattagtttatctgagaagctcattcatgtaaatgaattaccaatagacatcatttaatggagttttactacatgataggcactgtggtaaattctttataaacattatcttacaaagccctctatgatggcattatcttcatttataatttagggagttgagggacacaaagattaagaaatttgcccaaagaataattttgtaggccttagaagcaggatttgaaattcatttctatatgacacagagccctgagttctgatctttttgccacagcactgtttctgaaagtgtgtctacctgcatcagaatcacctaggctgtttgttgagaatgctggtttgtggaacgttcaaaagacctgctaagtcagattctttgggtgcagagctcaggaatctgcatttttttttgcagttttcccaaacctcccagacatctatataatttttagtcatgtaaaaagcttatgactttttgacaagttccataagaagtaaacacagtgatagtgctgtaaaaccctggtgcaagtcagtgagcaagacaattttgacagtccaaagtcaaagatgactgaatataccacagaaatctgaccctaatgctgtcagttaaattcagtcccatgatatgaagacttgatgcttttagagaaacccaaatcaaagtagctgaagctcaaaaggccattaattgctcttttaaaatacagctagatctaggtgctcaaccataatcatcaccaatacttttctcttcatgttttggttcacctctcctctgtgttggctttattcttaagtagcacttccaaagtggtgatgaggtggcccccaccatctccaggcttatattctgccaggtttaaattcccaatggaaagagttcatctttcagtgtaattccttgagaagtcctagggacttgggcctgggtaactcctctccgaaccaagcagaaatcagcagggtggcatgccctgggcaaacttgaatcttttccaaagtcctgaaactagagagaggagggaatggagagtgggaccagctgcttataagtcacatgaactgagagtaagggaggcttggtccccaaagggaagttgagtcttaatagtacaaggagagggaatggatgttgggcagacaaatcaatgaatgtccttctcactcatgaatggacaaaatgagttactctttttgctcatagtcaagctatcattttcccctaggtgactattggtagcataattttctcagcaaatatttttaaatgatacaaaatctaacacgatccagtgctcaaccaggtgtgtctatatatagatccaatagcaaactattcacatcagacccaattagtggagttaataaaatttatttcccagatgcttcaaatcactgaaatgaataaagttgtttatgacaggtcacaggacactttcaaggaccagttaaaaagtgctgcagtttggagagagctctgaggtcatgattagaagctgagaaggtggtagatgagagagtggaaagaataggaattttgctgggaaagctgaaagatgtgaatagaaatgaggatgtttctgagctgtcatttgcaaagctctcctatggctttgaaggtctttggaattgagctctcacagactcgttttattttatttgttcatgttttacttattgtaaactgccaggaattagcatcacttgtatttgcagagagaacttcatgggttggttaagattcttgtttctgtctgatgaatccatggtgttctcatggctaagagacagccactccaaccttgacattttccttgagcgagagaaccctgtcatatgactcccctgaattagtcatcagaacaatccatggtaagaaatacttgccttttttcattgctattgcctacgtgttgcttagattgctgcgtgaaaagttcagtttttataataagaaagctatccacaaacttaagtgtgagtttccttatattctgttccccttcaatcactttaattctgttttctaactcccatcctttagggatgatgaaaaatcctatgtcaggccttttattagtaagagtaattaatgctagccagcttaatgaacagcatccaattcttagtggtttaatagcaaattaatttcttagtgttgccattgtctgattgcttatttggcaggtgacttttcatttggtgttcagggatcctggatctgtccatctctttttgccagtattttctaaaacatcctaagataaccctccttcatcctctgcatccagtcagctaataagcaaaaagaaagagcatggcacatcacctgaagggttttagagacctagaaattgtctacatcactttttcccataatccattggccagatctacctacaagatccacctgcaagatcccacctttactgcagggaaaactgataaatgtaatttcccagtgtacctaggcaggaaagtgggtttggtgagcattcagccacctcctgctacaattattactggggcttccttttgcttctagattatagtaaaatctagggaacttagttgcaaagtggagcctctttagcttataatattgcagctggcaatcctcatgttccaaacccctgtttccttgaggcttatgtgtctctcctttcatccccacatgggagtccagagaccaggtccgccttttttagagaagccatatagccatctgctcagtgttcttgctaatactctaggctttgccagggaatacatgtgactttccctgttctgggggccctgccttgggggtagttctctccctcagcttgaacttttgtcattttcttaagtacacacgcaccccacacacttctattctccccagtgcccttgggacattgtttaacttctattttctgccccccaccaaacataatggaggaagagagcatagaaaggcttggctaccattctgcaatgaagacagggaaaaagaccaagagaaaaatacaaatcataattttaaaattttgccataaataaaagttgagatgcattgattatattgattacttatatcggggttatgccttatcaacaacccagttaatcaacaaaccagttacgtcaggcccatgccttattaacaaaccaatcctatgagttaagtaacatttctcccattttaagatgtggaaactgagacttgaataagttgtattactcatctctgggcatactcctcattaggtggcattcatgacaaggacccacgtacagcagactccaaatcctgggtcagtagccactacatcactctgcagtgcctgatcagtggggaagctataactatgacattctcagtagaaggcttgccaacccccagaactgtgcagccttagcagacagggatagcacattcgcatttaccaagcctttaccttatgccaggtattacgttagtcagtttgtagattctgtcttgcttactttttccagcattaatatcatccctaacttacagatgagggtatggaagttgagtgaggatatcgcctgccccgttatttcagatggagccatgtctcaaaccctaatccctgtgactccttagttcacactctattccactctcttatgccttgtagaagtcctgtcactgtgtggcccaaggggaagtgattgtcccttgtgatctatgagcgtcatagccaccccttttaaaagtcttgggccacaagttggaaattaacaaatcattccatccataaagggaaaatggaaagtgcttcacatgatacgtgaagattgagtatgatccaaacctaaagaaaatactgatggaaatcttattcataataatttctcttcatttcttgtaaacctccattatatcccagtttcatgaagtaattgcagggtgtcaaacttgaacagcttaaagttatataattaattgcattcagcttcagttacaattactaattgatccaagcctgccagcatagcacctggcagcagtcaggaacacaacagcggttgcaggcaggtggttgcaataattaggttactactttttttcccccttcaagtaccaggtggtccaaaccccagggtcaagcagactgtatttggcccaagggtaccgtttctgacatctgagttcttttgaagaaactaagtgcagtggcagaatatactagcccggaacatggtaaaaaagcacaagcaccaaactgggcttactgcagcagaatcagggaagaggatccagcatcccaaataaggtctggagaaagggacagactcttaaaccagcagtcaggatatttctgagattttggctttcaggctagcccttctaactaggtatctgggaaataagaaggaatgaggatccaaaagcaggcatgcaatctgagtttgtaagcaacgctgcctggtagtcataagcatcagactggaaatcaggtagatgttcttgtttgtctgcttggttgttttattttctcctgggtctgcttcttattaagtgagattttaggcaaactacatgactttgctaggcctcagtttcctcatctgcaaaataggaacagatactgtggctgctgtgcccactaaatgagtaaatgcataaacattgctcagcacatatctgttgggcaataaaatgatccattaatgttaacctgttttatctgtattgtatctagaagggaaaacagttcagtgacctacattttgaattgggtatttaacaatgaatataacttcaaaatgatgaacagcatcattttcatctttataatattaataataactataatttactgagtatgtgttctgtgccagggaaaaaaataataagtcttgtactagctttaattaatgccatccttatctttaatgttgatattaatatccctattttatagatgaaaaactgaggcacaaagaggttatgttacttctctgagaggaaatgaggaagatgagttagaactcagatatcctaattctgtcgccaataaccactgtgctttactgcctttataagccctggggaaaatgttctcaggttctttctgacaatattaacaaacttttatattttaatgccagattatcctagcccagctcttgtattttagttcagattgacttaaacaatagccatgatatagaaaacatgtttggagcatattcagaaagctgggaaagctattattattatttgttacatttattttttatttcattgcttttctctatttttgtttgctgtctttgtgcttacaacatgctcttgagcatcctgtagaaattcatgctgaggtcaatgttaagtggcaggtaggaaacttttataggttcatgatcttaaatcagaaagcagaacattgccaagagatattaaaaataattgcaatgaagatgatcacagctctatcaagaacatctgataagtaagcttgttatttactggaaactcatttctcccaactgctgtaaagaggaggagaaaaagccttgcctttcttggaaggcacaggagcaaacaggaaaaaaaatacagttttatttttaaacagttttgagtcttttctggagatgttttctaatcaatagaaaagactaagaaatcttatggtctcatctcccaggttttatgtttcccatttatttaaccaagataataaaaactcatatgtggtctctttagtcatttccaaatagggctggcttcttcagtttatctccaaatagggctggcttcttcagtttatctccaaatagggctggcttcttcagtttatctccaaatagctctggctacaaatttcatttcagaactgttgttagcattatcaactgctaggtggatagacagatatcacctttggctttattattaacaaaaataagtctacttggtttgaaggatttgagttataataatgaaaaactgtgtcttgttttttggcttatgaggaaaagctgtgaggtctggccaactttcacatttgagtccctttactctcaatctattccctcagtcttggatttaacaagttccagagatcaatagctttctcttagaatgagcggaaattaaaatctgtgatgaggcttcacccaacccccttacaaaatctgcccctggaaagcaacccaaatattgaggcccaatccaatggctctgcttgccttttattcgcctgacagtcccagattgagaggaaatggccttcagattttggcaaatcttttacactggcattcatattgctgaaatttctcagccacatttccgattcagaagtgcctccccactctgtgatgtgggtccaggcagctagcttcccagcaagctttgagaatccctactttcttatccataactctgcaagcaatgaatgtgtgcagcatacggtatagtgaaagggcattgcaggtaggggctggtttcaaattcaacttgtaaggtgtaagttgtatgacttgctcatgaagctgatatacatttctctttattgaatcttgatgacatagatactagatacattgtggccatttttcgtgtcagcttggagatggctatgaggtctcatcaatcaaaaagtcttacccagtcaagttttcagggttaggaaacattagtctttattcagctgaatataaggtacagtcattggctagaatagagggccatgacctgtgcagaatacatcattaaatgctagagttgtactctgagatgagaaggcctcactttgtgatgaccttaacattttttggatcctttgccatttgcatattacttctttcttttacaaatatatgcccttgatttcatgtaatttaattgaaataaatgcaagctacagcatcatatatgtattttgtgatggagggcattttgcatatactgaaataaagagaaattcttgtagtttgaatggggaatatctgcacctcatatcaaagttagacaaagaagatggtgactgaaggaagaaatgaaatcccaaatgctggggaagggcatggcttttgttcaatctcctgttcattcaatctgcaattactgaatgccaaccacattacaagcattgttcaatttgctgggggctgagatgagaagggtatgaattttagtttcgaagagctcacagtcttgtcttgagaaagaaaggtttgacagacagcaggaaagccatgtgacttgaaagaacatggggaggactggatagaagatgatagcacaccacctgcaggggtgaggagccccattctgagatcaggagagctgattcaaatcccctcatcgcctgattagcagtgaaatcctatgcaaaatgcctgagttgtttctttatgtgaaaatgaggcagctggaccatgagcctattaaaattccgcaaattgtgctccttgaaaaaaatagttcttcgtggtattaacgggagactttgagaggcaaaacatgccagaacgtctgtggtcaaacaatttaagaaattattagcaacactttctgtaattgagtatccccatttttctaagaaaagagaatgaattactattttttaaattattttttcttcttttctcttctccacttccccctgctccccccttcctacttagttttttagagatgcaaataatagccttttacttcctcttcactggacacttcctacagggcaaattccagaacagaactctcaaccaccaggaggttgcctcaagagataacagttgacttacaacctaaagtatgcccactacaaactttctcccacctggaaagtttttggccaccattaaaacctatttatgcccacgaagacaccagctcagctgctcagtagataaggcaccaaactagcacatggaccacccccacctgctcatttctatcactatatagtcaccccttttaaaagcatcctctttctgctgcaaaatcgaagcagtcttcttaagggaagaaggctgtacttcttccccttagctagctttggaataaaaagtcacttttctttataccagacctggctcttgttaattggactctgcaagcatcaagtgaccaaacctgtgtttagattacatttcctctaataggcagactgaataagtgtatagtagaaatggaaagctcttgggcttctgcaaggtcagtggtatgatctttactttatagtgagggaaactgtgactggaataaatgaagtaacttgccagatagctaagacagctaattgtagggcctcatagagcaggagtaagtgtacattttttataaagggaccaatagtaaatatttaaggttttgttggccatatattctttgttctgttgcagccactcaactctgcaatgtaatatgaaagaagccatagattatattgtaaatgatggacgtggctgtgtttcaataaaactttatttgcagaatccggcagtgactggctttagcaagagggccttagtgtgccaactcttatagtagagcataatgggctttggagtcaaaccgcccagaagataatatccccagatatgtctttttctggctaagtgactctacagaagatatttaatctccctattcatcagtttcacatctataatgtgggcataataatagtatccacctcagagttgtgagaattaagtgtaacatctccaaaacaattataatagcacctagcacttaatcaattcttgtttcattagccatttttggtaatagtcagcaattaatcaatttccctaccgtcacatagttattaaaaagtggggacaggatttccattcagagggtcagggtctggagcctgtgcttttatctgaactcgacctccaatgccctctcagagctggaggagaaagggtttaggtcaggtctggctaaccgcagagcccatgctgccttgccacaactggcctttctgaccatacactcaatggataatggtccacacactcaatgatcacagcgtgtagatttcaagtgggtcaaaatgcaaatacccagggcgttaagtgtgtgggtcactatccatttagatccacatcttaaaagaaatcaggaccatgcctttaattgcttttgtttgaaactcttcataactatatttactatacatatatgtaatgttatgataatactttgatgtcaacacaatctaagttaggaagctacaaaaacaatgtttacctctatcccaaggacataaattttcccatagaaggtataacgctatgatatgctggaccaaaaaaattaggcttatgattagggatactcactatatgtaaatctgtacttaatcctaaattttctagtttggaatttcatctgtgtacttaacctccatttctaccactggatttatgttctattttaagagggtacagtgggggttctcaaagagtagtctccaaactggcagtatcagtgtctcttgaaaatgataagagatgttagaccttgggccccacctcggacctgctcgattagaaactctagggcccagaatttggtgatggaacccagcaatgtaggagctgtgtaaatcattttataatatttctatcacttgtataccaccttacatttttccaaaatacttaaaaatataattcattttcagcttcaaaataatctttaaggtaggcaggatagtaggatggaaataaatgtttgcttatatcattttgctagtgagaaaactagacaagcatagatcttgatagcaaagctaagatttcagactcaaaccccattttgttattattttgagttcatatttttcctcaagctgggccttgtttacttatatttagtcttattggcatggagacttgatcatttctccttgattagtgttccctggtaccttttgggttttaccttcagattcataattattaattttctagaccatgggtcagcaaaactggcccaccaccagtttttgcaaacttttttttgaaacacagccatgctcatttcttttttatcagctgtgagtggctgcttttacactacagcagcagagctgaagagttgcaacagaggttgtagagcctacaggtcacaagttctctactctttggctctttatagaaaacatttgccaattgctggcctagaagcaatagatttctcacataaagcctgataataaatagcagaagagggccattcagtttcctaactttgacttcaggatcaaaggttcctcaactcttctttgcatgtatttctcagtggtctagaccagtggtactcaactttttagcaccagggactggttttgtagaagaaaatttttccacagatggggttgggggatggtttcaggatgaaactgttccacttcagatcatcaggcattagttagattctcataaagagtgtgcagccttgattgctcacatgcacagttcacaatagggttcaggctcctataagaatgtaatgcgcggctgatctgacatgaggcagagctcaggcagtcatgcttacttgcctgccgctcacctccatggaccagtgcctgtctatggcccaggggttggggacccctggtctggaccactctgctcattaagactataattttttctaccataactggtaaaactaagtttactctctctctccttcccctatggctcaatagtgtggactttattttgactattaaagtatctcaattaagtattttctgggagtccattaactgtgtgtttgccagtctgacataataaaattctgaaaacactccaagtgaaatattttaagcccagacaagaggcagaaaagcaaatataatatactcttgcctctctgattatgttatctgaaaaacctaaagtgctttctagtgcactctatgtccagactcagaatgaggaatgacaaaatttttagataaattggtttgtgaaatatttatgtgcactttagtggcatagacaggaggtaatctgttttgtattgaatcagcttgggacagaaaaaaaagcacaatgttaatgagattttttaaaaccacttttaaattcatgttggcaaaagacaaatagtcaagacttttaatttctataaacttaatgactagagaacaaataaagctttattaacttaaataaaagtaagtagcttttctttcaagagcataacaatttatttttctttctacgtaatcttctgaaggactactcttttctacatattaatcatccttttccagtgtgttagtttgattttaactaagtactgacgatggtgaaaaatcacagggtgactccagcttagtacactgggttaagcctgtggtctgggagttagccaacattatttccctataagatatgcaatgtccttgctgtattacctttggccaatacttgctgtctccatttcatccactggttccacccatatgtagacattaaactgattttagtgtctgatgaagttgatgctgcactttgaatgtgttagttattctagaaaagtagagtaaaggctgagtccacccttaagtcaagacttcaaccttcgatttcattgatcttcccaaacgacggtcagatatgtttgtgctcccatagtgttatgatgctcccatagtcttttatacttatttatctctatcatggcataattcaccctggactgaaattactagctgttttgtttgtattcccttttaaactatgacatttttaagggtagaagctggattttgttcattacagtatcctaagtacctggtttgccatcagtactaaataactttctgatggatgaactaattaaagagacttaatttttaactaataaactggaagatctactagaaggatgggaaggagcatgtaagtagaccgtgtaaccagtcaaactctgccagggaacttgctaaggaacacacttccaggacaaaaagaaactaaatcccatctagacttttgcagtttaaactcttaggtctataaattgtgtaatctcttcaaaattttctgagctgatcctatatcccagtcttcccatttgtgcaaaaaccctctttctgctgaccactggcaaaatgctttagcttggattgctgaatgtgttttttaacagatatgctaatctcaggaatgatgcatttcagctctagcatcattaaaataatatcccattgccattctgcagttcactgctgagtcagcacgtttattacaatctctctcttcccaggttcctaatttggccataaaaattcactcagagtagaaacttcacataggtcttgcctctgaatggtattttttcaaacagaatctcaaagtaagctgtttaatgtacatgaactattgtggaattcacacacactcaagtagaattctgaaaagggcctttaaggtgttgtaacttatgctatcacctgaaatactgacacttcatagtggtgtcatcaggcaagttttgaataaatcctttttgtcccccttgggtaattgccctgggtatgttctgtagaatattcccagtttttgtaaactcgacaaattttcatttttgcagaatcttttctttttcattgcattctccctcccattttttatgcacctttgcttttacccagcttttgcctcatgatctcatctaccacatttgttccttttgcaacgtgtgtgtgtgtgtgtgtgtgtgtgtgtgtgggaggtagttacacggggaagttaaaatctagttcttagggttagctctcaagttttcacatatgattacccactttgtggattatctatgatgtatttttcctgcaattctactttcccaatccacttggaatgtaactgaatttattcctttctctcattccaatacacatttagtggctgtataaacacctctgcatatcctctgagatgtatcattttaagaatgtatttcccccaccccaactccctaaaatatatttaaagccaattacttaaatgctgttatgtatatgcctatatttgaagtccatgaatcctcttccttctatgttgtgaatgaacaaagaatagctgttcatacatgaactctttgcacagttgtttaagaaggataaagttcaggccaagggacagcaacccaaaagagaatctgaaaataaatgatagctcagaagtccatgatgttttgtgcatggagaactatcgactgctggaattttagaatctcaccttctatctgatgagtgactctctgtatcaacatctctaacaatgaaaaatgttagtaaatttgcagcaatctctgtggcataaggtgggaactcccaaaaccttttctttcaccagcaaaactgcctaataagcaactcccatgcacacagattctgtcccctcccaattctgtctgaagccctatatttagagaaagatttcttagggttacactttggttttaatttgtctcaggagaaataattgtctaacatagccacccagcttttgaatatgaagtatatagaagcagctaaaataataagcttagataatttaattcattccagaacatttgctacataccagctattttgctctactctgcagatataaaaggcaaagaaggtatggcttctactctcaaattgcctaaagtctgtgttgaaaagcataattaactagcatcctagagtagaatttagtattaaggcaaagcctgtttatttaacaaatatttattcatcaagtgctttctgtgtgccaggcacatttctaaggctgtgggaatacagtgatgaactaaacagacaaaaccctcccctcttgtctaaaaggaaagatggacaatacatgagtaattaagcttagaaggcaagtggcttcgttttgctcactgctatatccccagcatctactgcagtgcctggcacatagtatgcactcaaatatttaggaatgtgaatcaaattaattagtacaatatttccatattttaaatggtcatggaggactgagaagggaatagttcattctggctacaagagctagaaaactccagcccaaccttgaacggtctataggaaattgaaaagtgatgtgagtagacatagcaatgccagatagaagatagaaaattctgcgcaaagtcatagaggtatgaaagagcatagcacattgccaatactgaaattcagtgtggccagagatcggagactgaacaagtaggctgaaacgtcattgttaaggtcttatttgcagggacaagattttgctatcctatggacaatggggatacctaaaagttttaatcgtagtgggccttaaacccatctacatttcaggttccccctttcctgagctacttttctccccgtagctctttgtgtcttcctccttcctattagtgctttctttttcctctcacttgtcaggcagtctatcatgcaattatattatcatgcgtttgaggctctttcagactagtcccttacaatgagcagagttaagtcctctttcccccttatttagacagtaactaaatcatttgccattttgacacccctagaaaggtaaagctacctctgcaacagccaatggggtgtgttgcacagtggataagaagactgcagcacaattcgtaccataaaggaagccggcagagtctgactcttcacattaaaaattaacagtgtgcaatatacagcaaagcctgccacactcctcccttgtgaagcgcataatgggagagcacccctccctggaggacgggaagggaacattttcgtacagaggtgccaatttaatcatcagaggaaagttctgcgaatcaaatggagggcagaactctcaggaagaggctggaggtttaattgcccatttgtgagtcctgaaatccccttatacgcttgtataagggccaggggaagtacatccgccgtgaagccttacccagtagacatgcagtaaatatcttctgaatgataaataagatcaaggatgtaaactggccacctctggcagatgcttcagcagtaagaatattctcaatattgttggtggaggctttaaggtttataaaggttttgcaaacgctgcctcttttcgtctttagcactattcagcacaaaacaggaattttcactattattcaaatgagcctcagggaggttaaatgagtctcccaaggtcacttggctggttagtgctgtggttgggacataaactcaggtctgccgaatgaaaatgtgggatgtttcctttatgctctgaaaacatagctcccatacagtaatactccagttctcaaagttttgtcagatgactgcttcagaatcactgcataaaagttaaaaatgcggccgggcgccgtggctcacgcctgtaatcccagcactttgggaggctgaggcaggcggatcacgaggtcaggagatggagaccatcctggctaacatggtgaaacccccgtctctactaaaaatacaaaaaattgccgggcgtggcggcgtgcgcctgtagtcccagctactcgggaggctgaggcaggagaatggcctggacctgggaggcggagcttgtagtgagccgagatcaagccactgcattccagcctgggtgacagagcaagactccgtctcaaaaaaaaaacaaaaaaaacagaagaagaaaaaagttaaaaatgcagagttgggggcctcaatcaatcaaccacactatgtagtaaggaatctgcatttttaaggaatctgcatttttaacaagggcaccagggacaaacaagtttgagaaccactgtaccaaagaacacctaacacaggttgaaatagtttaataaaagttacagaagtctaaattacttccaagatagggtggaggctgcagtgagcccagattgcatcactgtactccagcctgtgcaacagagacattgtccccctacccccaaaatattaaataaataaataaataattcccaggacaaagcttaaaaacaggagaacccacgtgtttttttaagaatctgtgaagacaactttgcacctaaatgtaaaagtcactttcaatgtcattgtcctgtggtagtgtcctctatttgttaatcagttttgacttcaaaatttcccatttttaggggccactgataattttatgagttttgaaacttttggtctgtttatttgtcctaataagcttcttttcagatacaaaaaaaaaaaaaaaagaaggcttgatttgttttgctcaacagcaaatcacaggaaccactatctcttgtgttgggttctattctttctagcccagtggcaattgctgtaattacagtgaaacttgatgaataaatgtgtctctatgaattttaaaaatctgaatatgtgctatgaatcaagttcaacagacttagtaatgatggtgcaaatcattcactgaaatgtcagaatgtgtatttagtaaccacacgttaattctcccttgtatatttacacatatgccagcttttaaagcaagtgttaatagttgatagtgatataactttacatttctgaaaatagtcataatgtagaccttgactggttataaataatgtcttcttaattctattccagtctaggagttgaaatccagaaatgactgtcttttctttagatcctggtagcaaattataattgtgatgaatgcattctcgtaccaacggtttagctaaaaattattcctgattattttggagttgtgttgcttgccatgaggttgcaagtctatttctacacaaggggtctaaatttgcttttgacctcagcaattcaaatgtgcatattttcttttttatcttaagaatttattgggacaaaaaaatagacaattgctttttgatttcttatttatagccaggagtccctctcagcccaaagtcactgttctggaagctggatgcaatttctaccttctctgaacttttgaagtatattgtctttctttcatttataacacatcagctatctatagtagtatttttattattggaatgcatgccatttcctctggaaataaatttgctattctttaaggaatggtcatatttataagtttttatatcctaaacagtgtcttagacaaaatagatactgtagtagttagcctccaggatgttcccaaacgatttatgtctccatatatctgtgcccttcccacaccgaatccaggctggtcttgtatgactgattgaatatgccaaatgtgatgatgtgcaactttcaaagctaagtcataaaaggcactggagcctcttccttactctcttggatcacttgctctggacggtacgggctgctatgtcatgatgacattcaaccctttgatgatacccaagttgagaggaactgaggcccttgaataaaagctagtgccgaactgccagctctgtgattgaatcaccttggaagtgaatcttctagacctagtcaatatctgattacaaatgaggaaacctgaactggagtctcctaaccaaacaaattctacttcctttcccacagaaaccatgcagcaatagctgcttgatcacatatccctgaacatcttatttagtagatagaactttatgtctaacaaatgataatcattgctttaagctcataagtcttaaggaagttcattactctgcaataaataatgaatgtagaattctatggctaaaggcaagattataacaaatgaaagttcaaaatatttgatgcacactaaacttcatgacaatgagtctgtatctcactctgtgggtgatgtgaatatttttagagaaaagttactttttaactaggcattacaagaatagtatatgggtgaggtagagaaaggcaacttcaatttgtagcaaatgtttaaaagattgatggctgggcagcttcagcagctggccagaagatttgatgtccttgtaatgacaaagtttgttacttacagaagaggtagagagatattggcagtttagaaagacctttcaagaaacccttgcagaatgatagaataagtactccccaaaatctgcttctccataaaggcaatgagaacacttgcaaaagtcctcaaatgtaaatttctagagctctggaaattaactaagggcttataacagtctaaggagcacttattcagaaaaaacataagtatcagtaagaagatcaagatttatggaattttagtgtgccttattttcatcaccctgtcctcagatctgcagtatccttgaaaaccaatagacacacaaccgtggtacttgttagaaaccaacagtctagcagccactcaagggaaaaacagttttggggctccccaaaagccctcttcccagaaaatttttactattttacttatccagtggctccctataaatgcccaaagtccagggcttgtttttatacaatctgactgaaatttctctgtgcaaacagccctatccccagggtgtttgtcaaaaataatcaattgcagttgtttaatgttgcagctttctgaggcagctgtacaagtggcacaaaaggaggctgaccaaaatattttaaaggaaaaactgggatatgagatatccatagaggcatttgaaatgctccaatatatttctgggaatccagaaggcaacatgcatgttcagagctgtgcttatccccagaaataaaccgaaaatgccccaagctttaatctctgactggcattgaggctcagcaaagagtaggaagtgaaggctagggcagagctgtaaactactggagcattggaggcatgctcataaacacacagcccctcaacagaggctggaggatttattgattcaagtcatttaaggaaaatttgttcaatcactgcctgatcactaagccagttaagcagagacatagagacttctatggatacaggctacacacacacagaaacacacacacacacacacacacgtacacacacacaaatatatactttacagaattcatccaggaaactcattaagccaacaagcagcaacagccaaaacaagaacgaatagcaacaataagccctggggaagtatgataggcagaataatgctctccccaaaagatgcccatgtgttaatccctagaacttgtaaatttttgttacacgttacatggcaaggaggaattcaggttgctagcagctggattttaaatagcaatatcatcttggattatctagatgggcccaatgtaatcacaaaggttctttaaatgtggaagagggaggtaaaagagttagtgttggagtgatacaatgtgaggaagactgaaatagtcattaatgacttagaagatagaatgggctgagtgaaggaaggtagacagcctctagaagctggaagtcaagaaaatagattgttctataaagcctccagaaagaaatgcagtccttctgacatgataatattagcctggtgagacacattttagacttataaccagcagaacttcaaaataataaatttgtgttgttttaagttactaaattttggtgatttgtttcacagcaatagaaatgtaataaggggtgaaggaggatctgattttcagagtgtccagattatatattttaaaagtccactaccaaaaaagaaacgtatggcccatacacaggaaaagaagccaatcaatagaagctatctctcaggaagatgtatgttggacttactatacaaagactttaagcaattacaaatatgtttaagggactaaaattacctctaaagaattgtggagagtatgacagcaatgtcttgccaaatacaaattgtcaataaagagacactaaaaagagccaaatacagattctagagttgaaaattacaaaaactgtaatgaaaaaaaaatcaatggcaaatcaagtagctactggaggggacaaaagaagaaaaacattaacaaacttaaagataggtcaattaagattgtccagttcaagcaaaatgaagaaaacaaaatgagggaaaatgaacagaaaaatgtgtgtgtttaaaccttaggatcccatcaagtgtaccattatatagatgattgagtctagaaggagagaagagagagaaaggggaagaaagaaatttgaagaaataagagtctaagtcttcccaaatttgatgacaaatattaatctacagattgaagcagttcaacgaattccaactaagataaactcaataaaactcacacctatataagtcatcgccaaactgttgaagaacaaagacagaatcttgagagcaacagagaaacatgacttatcacatgcaaaggctccccaataagactaacagatgacttttcaccagaaattatggaggctaggcatgtgaaaaatgctcaatatcattaatccttagggaaaggcaaatcaaaaccacactgcaatactacttcatacctcctaaaaggctaaaacagaaaaaagtgacaactgttgataaggatggagaggaactggaaccctcatgcatgcatacattgctggtgggattataaaaggttgcagaaactttagagaacagttaagtagttcctcaaaatgttaaacatagcactgccatgtgatccagagattccactgctaggtatttgccaaaaagccttgaaaatgtttacagcagcataattcataatagccaaaaagtggaaacaaccctagtgtccatcagctgctgaatcaataaataaaataagttgtatatacaagagaatattactcagctataaaaaagaatgacataccgatacatgctacaacacaaataagcgttggaaactttatgttgaatgaataaaggcagtcaccaaagggcgcataatagattatttattgattaaaaaaaagttcaggatgggtaaatctgtagagacataaatggattagtattttcagggactgatagtagggaggaatagagagtgactgctatgcaaattgacaggggtttctctttagggtggtaaaatgttctaaaattacatattagagatggttgcacaactctgtgaatacactcaaagccacagctcttttgcaacatgagggtattatttttagggaaaatctgaggattttttttaaggaaaaatggagggttagctaaagagctatagtccttgagctcagtacaaaaaagtatcccataagccacagtatgtgactaatgattatgtaaaaaagctacattccatgactaatgattccaattcctactctgaaaaaaaatcaaagaaaacacaagaaacatgagatactgttattaaccttagcgggtttacttgaaatatgtacattattcaaatgtactaagatgtaaaaactgtcacagaaacatgaagaggccgcttaagagccctatataaataaatatatattctgtcatatttaatggatgaattacaactctaacttgtcagaaaacacatacatttctgggtgtgagctgccactcaagtatttgcaaagtggctcttgaatgatttgtgtgattcacaactttgacattatgtctgatgaaatgtcagtgatacagccacacatacacgaattggaattctagattttaaatatgtaaggggacatatatttatatgaagggcctattttaaaaacttcaaacacttaagaaacttgaagaattcaagacttattttcctatgagagtacatttatagaatggggcatggagaccgacaagtcttcactctcatattgcttattgtcttctcagtattaactctgatatttctcaggatccttgtaaataggcaacatggtgtattgtgttggttttttgccttcctttatagtgtttttagagcccttcccttcccttcatttttaaagtcattgtttttttcagaagcattttgttttttgaaacagcagtagaactgccacttaaacaatgctcaaataacagggttataggatatttaattaaaaaaatatatatttctaacttgcaagaaaatgcatattttgggacatgaatctatcacccaacatattttaaaagtggttattgaatgttataaaaacagtgcaatgataactaaaacctcttatagaagttttattccaaataaacaatgacatggactagcagtttgtgagaaatgcaaaaaaggccccattccagatctacagaatcaaaatctgaattttaactggattgtgctttataggcacattatattttgaaaagcattggtttgcatggaactgaaaaatggtggttggtattttggtttaaaagataattgtggtccatcgcaatagaggaaataagtaaattgatatggttttgctgtgtccctgctcagatctcatcttggagtcccacatgttgtaggagggacccagtgggaggtaactgaatcatgggggcaggtctttcctgccgccaagaagacagaaaaatgtgggaaagtttggaacttcctggagacttgttgaatgactttgacaaaaatgctgatagtgacatgaacaataaggtccaggctgaggtggtctccggtggagatgaggaacttgttgggaactggagcaaaggtgacatttgttatgttttagcagagactggcagcattttgcccctgccctagacatttgtggaactttgaacttaagagagatgatttagtgtatctggcggaagaaatttctaagcagcaaagcattcaagaggtgacttgggtgttgttaaaggcattcagttttataagggaagcagagcatgaaagttggaaaatttgtagcctaacaatgcgatagaaaagaaaataccattttctgaggagaaattcaagcctgctgcagaaatttgcataagtaacaaggaacccaatgttattgcctaagacaatggggaaaatctccccagggtatgtcagaggtcttcatggctgcccctcccatcacaggcccagaggcctaggaggaaaaagtgagctgaacccagggttctccatgctgtgtgcagcctagggacttggtgccctgcagcccagctgctccagccatggctgaaaggggccaatgaagagctcaggtcatggcttcaggggatgccagcttcaagccttggcagcttccccaaggtgctgagcttgcaagtgtacagaaatcaagaatgaaggtttgggaacctctgcctagatttcctagtgtagatgtatggaaacacctggatgtccaggcagaagtttgctgcaggcgcagggccctcatgcagaacctctgctagggcagtatggaagggaaatgtgaggttggagccccaacacagagtccctactggggcgctgcctagtggagctgtgagaagagggccactgtcctctagacctcagaatggtagatccactgacagcttgcaccatatacctggaaaagcctcagacactcaattctagcccatgaaagcagccaggaggaagtctgtaccctgcacaaccacaagggcggagttgtccaagactatgggaacccacctcttgcatcagtgtgacctgcatgtgagacatggattcaaaggagatcattttggagctttaagattcgtctgccctgctggactttgtgcttgcatggggcctgtagcctctttgtttcggccaatctctcccgtttggaatggttgtatttacccaacgcctgtttacctgctgtatctagaaaataacttacctgtttttgattttacaggctcataggtggaagggaattgccttgtctcagataagactttggaccgtgggcttttgagttaattctgaaatgagttaagactttgggggatggttgggaaggcatgattgtttttgaaatgtaagaacatgagatttgggaggggccaggggtggaatgatatggcttggctatgtccccacccgagtatcatcttgaattcccacatgtggtgggagggacccagtgggaggtaactgaatcatgagggcaggtctttcccatgtttttcttgtgatagtgaatatgtctcacaagacctggtgattttaaaatgggagtatccctgcacaagctttttctttgcctgcaccatccacataagatgtgagttgctcctctttcccttctgccatgattgtgagacctccccagccatgtggaactgtacattcattgaacctttttttcttcccagtctcaggtacgtctttatcagcagcatgaaaatggactaatacatgaatataaatacagtttacaggcaggatgccatggctcatgcctacaattccagcacattgggaggtcaaggtgggagaattgtttgaggccaggagtttgagacaagcctgggcaacatattgagaccctgtttctacaaaaattgaaaaaactaggtgagcatggtgtcaagtccctgtggtcctagctatttgggaggctgaggcaagaggattgcttgagcccaggagttccacctcacagtgagctatgattgcaccactgcactccagcctgggtgacagagtgagactccaccaagtaaataataaagtttacagatcatttagtctcccctataattttgatgaagctttttaattgacaggatttgcattagttcaaatacttcccatagtgggaagtgctattaccattttgatatcatactcattaaaatttgcataattcatgttgcatgcacatacacatacatatttaccacttctctattcccactaaaccctgaccaatgtgtttgttcgtttagacaatgcccctcctgggacacccaggccacataaaatagcaaagagttcattagaatggtgtcaccagcatagctataattaaggctacatcagcaattttggggcttaaaactccattgtaaagttgtattctgggatgaaactcagcacaaaagctcaacctgggagtagattgtttactagttctgggaggaatgtggggggaaattgattcagttgtttatgattcactatattgctcatctggttcttggtggcatttgaattaagatgttttatagactggtgatcatcgagaactggtattttcaccgaagtcttcatagaccttactgaaactgtaaatattacagaaactcagatggtgtcaactgtttatattctatgaatgaggacaaatatgcatagggatgcaattaaaagagaaaaggagtaattctaattaggcagaattggtaacatatttcatcaaagtaggacgcagagaattccttagttgcccacatatttctgccaagtagacaccaaggcatgctccctcgaatttgctctgggatatttaattggtaaatcaacattaatgatcagagaagtttagaaccagctcttttagaaaactgagattcacacttgacttctcttagatgtagctacagagctcatggctaaagagaaaacctcactaatgaaaaaagtcctggaattctgtgcttcttcagcttctttactactaccttgctcttttgaagagagaaacttgtcatcctgagacttctagctgtagtaatcaggaatataataggagtaagctcctattatattcaatttgtgattagatatattgtcatcttgggtacaagtttaaatgtagttttaggcagttatctaaagtgtagtcccaatctaaataattagaaactcctaattttccacaagggcttaactattaatggtgaatataatagttacaagctggaagtcttgaggaagacagaaccaagttcaaatgctcttcctactccttttataatctgtcttgtctttgggcaaatgacttaatacccatgaccttcagtttctccttctaaactctgatggtaataatagtagatatttcagaggatggtcaccaaattaaaaacttaaccctgggctgggcatggtggctcacgcctgtaatcccagccctttgggagtccgaggtgggcggatcacaaggtcagcagatcgagaccatcctggctaacatggtgaaaccccatctctactaaaaatacaaaaaattagcctggtgtggtggtgggcgcctatagtcccagctactcgggaggctgaggcaggagaatggcgtgaacctgggaggcggagcttgcagtgagccaagatggcaccactgcactccagcctgggtgagagtgcgagactccatccccccctccccaaaaaaaaatacatgaccctgcaaagcaccatacctggtatatggtaactatttattatgttgtgtgatggcctaaccaaaatttattttcaagttgtcatctatttcctcattcattcactcatacaacacatacttatcagttgcttccactgtgccagacatgctgattcaatgctggaaataatagtgagcagggttggcataatccctttcttattatttaatattgtagtggaaggaacagaccaaaaacgttatcaaagaagtaaaatgatcatgattttttataggtgttaggaatgaagcaagcaaggggttaagatggaaattaataatggagagatgggtatgagaattaattcagagtgttcagggaaggcatccaggaggaggtatgtataaaactgttacctaactgacaaacaggctggaaaaaaagctcaggaaagatactccaggctaaaagagaaacagatatatatgccctggggcggaaataccttggcatgcacaaggatctgaaagacagctacttggctggaccacaaggaaggtaaggtagaataatgagattagctgggaaaaggagaaatggacaaagtagcacaaagctttgttatccacgtaaggagtttagattcaatttagagaatagtgagatccctagaagagatgatgtactgaggtacactgtttaaggaggtgcttccagctggtggtggagaatggcttgaagaaagtcagtagtatctctctgagcttccttatggatcaaaggggaaatccccaaacacacgtctggggctattttgtagccagtgaattctgtgataaactcggagatattgtatgtttttactgttaacatatcaaggaggagagaaggtggtgctaagaacacacttatttgatgaataagagcagttttttatagcagaaccactcaagactacataattgctattttgaaacacacatcatcattcataatttcattaggctataacttacttccaggaaaactatattttatgtcaactcatcttccctgaacagaaaccctacttttggcatttttaaaatttaaaattctaggacatataccagatcagcatatttctttgatttctttcctctgtatgtagaaaatatttttaggctttacaaccctacattactaaatgaccttcagaacttaatttaagtgcacaagtattacagaatgaaagtggaattctgatcttcattaggattttaaaatttggatcatgttgttcctgctcattttgttcatctttccatttttcctccttttaacattggtctgcatttttaaagaaaatgaagttgtaaaaattgaactaggggttttctttttctgtactccttgtgtttctaaattattaaataataatgtaataacaagcacttatctagtgatttattaaagaacctcttgtttgcaactccagccctggagaacactgaaaatgttttctttgtaaagtttccaaagtaacatcagctaatctgcctcttcttgatgtaaccgcacaatgctagaatttttcacttattaattatcaaataaatgaattggataatagatatgtgaagtagaaaatagtttcttttggattgtcaaataaggtgactttgcttgaatgcatgctcctgaaatttgggaggacagtcttcccatctgtccttcatttacctgaccccatttatttgtatgtatgcttgtgtgaatgcaaataaattattaattatgcttaaactctatgaacaaatcagctagtgtacaccaaattttgacgcttgcataagattctttcctgcctataacacataattttattattattattattattattattattatttgagagggagtcttactctgtcacccaggctggagtgcagtggcaccatctgggctcactgcaacctccacctcccagtttcaagtaattcttctgccttagcctcccatgtaatgtagctgggactacaggtgtgcaccaccacacctggctaattttttttttttgtatttttagtagagacagtctttcactatgttggccaggctggtctcgaactcccgacctcaggttatccacctgctttggccactcagagtgctaggattacaagtgtgagccaccacatccagcctattttatttatatatgtcagactcatgttgagctgggttttcagattgtgagctgaaatggcagaggagctagatagctagtaacaagaggtaaaggatactgaacgagaacagcatcacacctgcaggcaatttttgtttgattagcccatattgtcccaacataagaagttcagatgatttatcgtaaatactgggatttatggtttcttttgaaaaatgagccagttgacaaaagtcagtaggaggtgagtagtgtctgccccttctagagaagatagatacttcccagtttgccccagtccctacaaccccttatttttcttggcaactgacatgtttcagtcatttacaattcttccctggcctctgcagacctttatgtgtgtggtcaccagaatagcaacatcacctatgtggtaggcagcttctaatacgacccctgatgatcctctcctcctagttttcatgcccttctgtatcccctctctctctgtgtgggctaggcctagtgactttattctggaaaaaacaaccacagaatacagcaaaaacgaagtgatgtgccttctgagattgggttataaaaggtggtgacttccattttgctggcactcttggtcttcccttctctagcctagctggttttcatgaaacaagctgcaatgctgcataaacacacaaagtacggacgagaaggccacctttggccaacggtcagcaaaaaccttgggcccttggtccaacaaactacaaggaactgaaccctgccaacaagcacatgagtgagtagatccttctccagttaagctttgagatgagaccataactgttgctgtcatcttgattgcagcctggtgagagactcagtcaggtggggctggctagtggggacccagccaaattgtgccccaactcctgatctgtagaaactgtgtcttgttttaagctgctgaaatttagagtaatttgttatgcaacagtaggtaaataatataccttactccagagaaagatggtgcactgactagaacatacaaaaaaaaaaaaaaaaacttccttagaattatgtaagtgaaggcagtaaatttttctgttccagtgaatatagttttggtctaataactgatgttggaggtactcagtaactatgaagtaaattcagggtaaccagtggtgagttagctgttatgagagactgttatactgataatgttgctaatagggtaattattattttttatgcactgtttagatttatcttttaaaaattcccttcatatgtggttccaaatattctgattatctaaagtatgtcttagatacaaaaatgttagaaactattgatcaagacaagttcccagaatactagactcctaatggagatgactggaaatggcttagacatctgttgtgggctctctcagcacacatcgaaaggaaaagagtggaggttgcaacactttcatctgtaaaatagggtgaaatctaagttatgaaagaagcagagcagagctaaaacattgtctcaaagatctggatgtcattccttacttttaaactatatgataaatacagtttacaggctggggatggtagttcatgcctgtaatcccagcacttcgggaggctaaggcaggaggatcacttgagctggggagcttgagaccagcctgggcaacatagtgagaccccatctctacacaaagcaaaaaacattagctgggtgtgggtggcacacgcttgcagtcttagctactggtgaggctgaggcaagaagatcacttgatcccaggaggtcaaggctgcagtgagtcatgattaaaccactgtactccagcctgggtgacagagtgagaccctgtctcaaacataaatgaattcataaacagacagacagacaaactgtgtaacccttaatggatttctcagtattacattaccaggtggaaaattggatactattcatttctttattcagcaagctttgtaaaagccccagtgttgtactgtgtattgtgctcagtatggagatacaaatgaatgagatgtatagtgtgatgcatggtgccgtcagcttctggggtggtgacatttacatacaatgcagtagtatttcattcaaaactactaacagtttaacatccaaatatcagaaatgggaattagaaattattgtaccaggttattgcttcaattggtactgttgttattactaatttatctgatcctatagaatactgaatttatcacattaacatgaacaacatccaacacccctttaaagtacttaatgcacaacactcttttaaagtacttgtcaacatacacacattttaatgtgagttttaacataatgtcttacagcccttaagtcatttctgtatataaaccttgcattcttgtaaaccctacgtaaaacatattgctttatgcactatacacatttattagcaatttcagccaatttagtttattatttagtgataatgtcatgttttatggatgctgtttatattttatgcatatggtggtgataagaataggttggattgcattgaaaatataataaaaagaaatataatttgtgtctaggttccagaggttcatagataaaatgttgaaacaaatcatcaaagtcatgtatctttatttcagttggttcaaccaaccctcccaaataattatcctatcagaaaattcttgcactactcaatacatttgacctgagcagtatgtgtgtagttttatcatcaatcaatagtatacctgccccatcgctttgggtgaaatggtggtttgagagggctttaattcttcaaaagatccattgactagttttgcccaagttcaccttttaaagttatcccaggaccacttattgtgcatcaagtatgagaagtggagcaaaggttaatgattcttaattggacttcattaagtgataatataagatctcgagctcctcattatgccccatgattggacagcaatgtcataacatcaggaaataaggaaccagaagtcatgcattgtcatacattggaacactctagcaacttattatgtttcagatacattgtctttagtgaggtataaaagtgaggtgcatattaatagcttgatgaagttcccattttaagacaaagtatatttttgatgcaataaagactttgattggaactattatgatcagaagactgttggatcctgtatatcttttcttattatttattagctgccctcaacagtgagaaggttattggatcatttcacagcttatgcagtctaattgaaacacagaattttgttcatgcatcacttttgaatttagggactgttcattctttcattacctgtgtggtgatttccaacccactttggtaatacaagggattgtgatagcatatttgctcctaagcacattctatttagatcagagtcagttctatagttctcattttgctctgagaatgggaattgatgcatacaaaacagtagtaactgtagttaacatgtcagggaaaatgaatgcacagatgtgtactatataatgccatgtgcttcagagataaccacagtgagggatgtaagctaaccttggtcttctgtaatgcaaagctaatatattcaaaaagatattccccttcattacgatttaatgtaattgttcctaatctgtaacctgaacaaaaaactcaaatgtcttatccaaacactaacattaagctgcttttctccaggatagcgatatgacactttacattcatatgcctcagagaggaactggacatcaaaaagtgtcatacatgctgtattctccctgaaattttctgcgaatttccgtgaataaggaatcaaatgattaggttgacactaacatttatgataattcagatgattgacagaggatggatacggtaatgaaatagatcacctccacaagttacatgacagcgatttcaaagcattctaagtcctacctgaaagcaaatatcaggtttgataaaccttgcagggctggaggcttagaaaattattagagtctgtatttggaaacactgtggctagaaggtataccaacatattttctacatttatgatgataagcactgtgtgcatgtgtgtgtgtgaaagcaaaagaaagagagctgatttttattctctataaggataaaaattattattttttgcccctgaaaacagtctgaaatgctacataggtaatttttggcatgtctcttctatccctaaagcaggactattgattagctccaatatatactgggaacacgaaagctcccatttgctaacaaaaacaggtgttgaacgaatattaggtttgattaaatgagcaaaggttaactactcactcatgtgaaattgctctagagaaagaaagatatcaggcccaaagaatgttgactgccatatgtatagatttaatatttttcatagtggcctgtggaccaccattttacttgttaaaaatgttcactcttcaacccaatgtgatgaagcagattcctatgggctgagacatgggaaagtgtgttctgcaaaaacacccgggatgtttttctacatccttcacttgaacaatcactggtatacattcaatttctcatttgaaatgctgtttttcttcattcaatttaaaccaataaatatttaaccctgctatatgtcagggactctgccaagacaattgtctaaaagcctctgttctcatgacactcctaggctatcagagaagacagacatctgagcaagcactaagtggagatgtgtagccagaggaaccagtccgcatgggagacagcaagaagggtattcctgaggaagtgacatttaaagggaccctggaaggatgagtaggagccagtaaagtgagggtaagaagggaaagagaagggaaaggacgtttccaaatagagcaaatcacatttggggagccaacatcaataaagaagaatggacttgaaatacagaagccttaatggcaggtaaagagagtagaagtttgtggtatgtaaggaggtagaagggactggaacctcaaggatggtataaggctgtgttttccagtctttggtattttcataacattttcatggtttgctccaccagagtacagcttgtactgttatttccttaatttgttgcattaaatctattcacttcttgtcttaaatgaatttattttaaaataaaactttgtatcgctatgtaaatgcaaccacagtatcatctaaccttagtagaaagacacctttaaaatgaactattacaggtgcagtggctcacacctgtaatcccagcactttgggaggccaagccagatagctcacttgagctcaggagttccagaccagcctgggcaacataaagaaacttcatctctacagaaaaaatacaaaaactagccaggtgtggtggcgcctgcctttagtcccagctactcaggaggctgagatgggaggatcccttgaacccaggaagtcaaggctacagtgaaccatgattgcacttcaacctgggtaacagtgagaacctgtctcaaataaaataaataaataaataaataaataaataggaaacaaaatgaatttgataaatcctaactcaatgttgatttcattagaagatgctgagcatgaagcctgctccttgtcaaaaagggaggtgagcagtgttaggaggtaaagtcctccaccctactagcaacatgaggctttctccttggaaagaaagctggaaaaacaactttctcattgtgcaactcagagatgtttattgccttagctccccctttggtgtgctagcgaatatcatcttgagggtcttttataatacatttctactctttgggaataattgttattaatcatgaggattttgagttttgttgccagggcaattacaaaccagtggataacttctaaacaggtcctggtgtgcttccctaaccctttccgcagaagtacccagaacagcctgaaaccagagcagtaagttgaaaatgcctccgagttcccaaggtctcttttaagcattccaatgtgatgttgtactccaaagcataacacaacccctctctcattgtaataatagatcattgaatgaaacctatgttttactaagacgtgagaactgaagttagacttttgtttttttcccttttctttcaccattgtatgcctcatctcttgtactgggacagacacgttgtagttgtatgattaatatatgagaagaatgtttatcccatccccacctggagataagattattgttgattcttctgtaggtatctctacctgtctacttaccgtcctttatccagggacccaacctgcctgggctttccttcctccccaactccctctcattaattcattcatcgaacattggtgtgtgcctggctctttagtaagtgctcaggatgcattgaattgctccaggctgctgaggaagctcaagcttttgggatggcctttaatttctcaccttgctaggagatgtcccttcaaaacataccatgggcctagcccacatatgattcttctgaaaatcatctgtccttcttatctctgtgggtaattagcagtttcttgagaatgtgtgaagtttgtgggaaaaaaaaaagccagtttgcttttcttagatatccatcccatctttaagtttatattcctagtttcaagctgaactttcaggaaattaggagtaccttgtcaataatgaaaccttgaattctgagtaaattcattttacctgttattatttggtgtggattaaaaaataaaacatgaatattgtcttttacgtgtgtcctccatgcaaaatttgacatcaccttctgtttataagcagcctctcattatctttttgtgtttaggggagtatagcatataaaaaaagaattgtacaaatataatgtattacttaatggattatcacaaagtgaacataaaaaaatagagaaataaaacattgtcagacttagatggctttctcatgccccttctaatcaccttcatccctggccaaaggtatgattctgtttaactctagagattagctttgtctatttttgaactttctatggtgggctgatacactcattgtggcttcacttgttcaacagcaggtttgtgaaattgattatcttgggtgatatagctcatctttgcacagtatgattacaggacaaattttagaaatcctctgtaatactggttttcaatttggggctattacaagtaacaatgccatgaactttcttatatgtgttttgggagcatgtgtcatgcatttctcttaagcacatacctgggagtgggattttggatcatcatatgcaaagcagtgtttagttttagtagaaaatgccaagcagttttctaacacattacacagcttatacttatcccagaagcaatgtatgatcatctttttggtcttaaattcttgccagtgcttggttctgtcagtccttttaattttggccattttagtgagtattatggtagcattgcggctttaatttgcattttgttaattactaatgaagttgagcaattgtttgcatgattatttgccattgggatattctgtttaataaagtttctgtttacatttcttgcctatttttctattgggttgtctagctttgtcttatagatttgtagaagttattttatattctgaatataagaccttgttatctctgttccatattctattctgtggattgcctattcatattcttgaggatgtttatttccttccttgcttttgaaatgaatagaagttttaattttaatgtaattaaatttctaagtgctatttgcattttgtttaggaaattctaaattagagaacactaaattccatactgcgtaacttttttggacattgataggaataagtttgcaaggttgattccaccacatcacttgctaagtttgctattttaaatagtcatttggctttaatacagaattttaaaatggatgattttctctttgcatctattctgcatgtcttaaaggtttttttctatttcttagctatctttctaaatgttttgctgtacagacatttgaaagtagtatctctctaaattatatatatatgtatataatgtatgtgtatatatatttatatatatatatatagagagagagagagagagagtaccatcagaaactagcatctaattttatttttatgtatttataacaatttgaaactaatatctcttatatctatgttatgtttacagaaccagccttggcttttgcagttcagtctttgtgtttccattaggtcattaagtgtcttagagagagaggaaaattgtttttttaaactctgaattccatgctattttgcactaaggacagaaccatggtagggaacaatgacttttgatgctgaccaacattttatgtgatgcttcttttgattaatttttatcatccagaatagtgggggttttttgttgtttttttgttcgtttgtttgtttgttttggagctttctgtttccttcatggatacaaggccaggtgtgcactttgaatggggacgacttgtgaccatgcttgtgtcttcataggtccagactggtcagcagttttagatggtcagactttccaattggtggtacactaacgattatgttctcagggactgatttgcaccaaataaaatccttggagtgtgacccaaaattttggaaggtaaaatcatagagtggaagttctgtgaaggtgaggactaatgttgttcatcatcgtattcccatggctgggcacatggtagatgctcagtaggtgctggcttattgaaagagaggaagactgatatattaagtgcaataaccagcactttccatttcatccttggctgtttccattcagtagactcacctacatgcctctgttttatagtacaagaaatctagccctagaaagcaacttttgttaaatgttgcttcagactgatctttactaccattcaaccctgtccttgtccttatttccatttttaaaatttttggctctgtacaccctgcttaaatgtcagctctggggttggcaagccattttagctaccttttgtgcacatatcaaatatgcctgccctctcagagctctgcccatcatcttgatttcatggcctcattgagaccttcccacttccagctctgggcctttagaagttcacaccctgggccaatgactggtactcagtcaagaaagggagcaaggtgagaagtatagtgggtaagttctcagttcagataaaaatggcctgaatcaaagcttgtctatttaatttgaactatttaaagtctctgagcctcagtttcttcatttctaaaatgaggatagtaattataccttcctcataggctgcttcaaatataaaataagatcatgcaggagaagggtctggcattatgcctggcacaaaagaagctgccgttaatattgctgttgtcactgctgcaattcttattgtcaccattgatattattagtcatcaacatgggggaatttctcctagtgtgttagtgaactttgaagacccagttacagagattgcttggtgaggataaattagaacaaaggaagctggcaagcctcatagatatttatatcaagctactgtggttgaatgaattgtctttcttcacttgagggaaattctgtcaaaagaactgctatcagtcatgtgaaatcagcctgatctctttcttgagtggtatcagaaagagatactaacgaattctaacattttgtcattctttttttccttcaggattcattgtcagtcaccaaaacttcttttatgtctacattaccctgtagtgaaagagatgatgaattaggtcacagcttatcttgctttcactcattacagcctagcagtctttctgatgctgggagcctggctatacttctggataagtttaagatgatagcaacatgtcactgggaacacatttttaagtgtttcttgaaaatggttccacacacccatctgaacttgactttcattgttcattttatttgttttctgaatacaaaatattgaagtaggaaaagtacccttttagagtccatcacctcattgctctgtttctgacaatgtgcttttaagaccattaacctcagggtcatttggaatctgggtaaaatgtaaatcccaggcagttcctcagtcttcctgtttttgctctgtgtcagtgggaacacttgtgttttcagcaggtgcccatgggattctgctgcacattaaatttgagatccatagccttagtttcttatggcggtaaataaaggtatgtgttttgggaggagtttgtgagaacagaataggaaatacaccatgtgggctgttaagttttttttcttaaaatatctttatgaaccatggaaagataaatttttcatttattcctaattaactatatatcttgagcttgtccaagcaaagtaatgtgaacttccaatgagactagagtatgaattaaataaaaaagtatccatcctgaggcacaattttaacaaatacctctcaccccacattgatttcctagtcattttggatactgcctacattgtactacttatgttttaaaaaccttaagactcatctgcgtagcttgtgaaattcagatatttggattcagctggtcttgggtggggacttaaaataaaccctacatgaaatccccatgtgaagagatgggagaggtgaatgctgttttatgatgagtctattgtgtgtctatcttgtttttgttttgttctgtctttccatttttaaattctgtggtaaacacattataatatatattttttctttgtggtactttttcttctgatattcctcatatggaatcctcaacaacaaggcaaaaagttgagtgtgtgctcagagtagtacatattaatttagagcttaaagacatttcctgcaggacatgtaggactattcagcatggcggtatttattaagccggttcaagcaatggaaaaacgtaactatggtcagagtgaagctaattatcttcataggtaaactgaagctgaagcttgtggcacactaacgatgctaagctaaaagtgtatccaattatttttgtctttcttaatgtctctattggtttggctttagtacatacctgtaggattgatgaattgaaatatttgaggaaatgcttatggataggtcaaattggactgtgttcatcagctcatcctaactctatagttgccacaaactttttatcacagcaaagagagtagaatcaaagaaagggagataagacttttttaaaaaagggccactgctcatcttaaggttacaacatattaggtaaacttggtttcatatagattttgtacaaatacaagcccataagccacatgataatgggcacctgattttcactgtgggtaattctggaggcctgattgatatagttattatctaagacgtgatttggtggtgttttcgtaaactcttcaatgtcactcaatcacttcaacgtcattcaatcaatgttgaataaattattcactttctttgcttcaaccattcttaggtgagttctaagtataggatctctttctatattcttggtttatctgcttttgctttggtttccctttcctttctaaagtcccgcctacatatatcatcagctttagttcctaagtgcttcttgtcttttcagctataagagcactattcgctctagtccaacaactatttactgagtaactactaggtaccagatccaggtgctgtaagggaccgagtgatacagcttttgctctcatggagattatgacaattaaaactaaacaggagtgattaaaattatgataaatgaggtcttttcccctctcttgccctgtaattctctccaaaatgatgcatttggcaaaaggttgaagactaggtcactccaagataaagttctacctccttcaccacctggcctccatgtctccattatgtggtcatggcatctgccagtgtgttacgaatgaaaacagatgagaaactgaatgtgtctgatgggaataccgcaagttgctcattgagcaccattatgatgtgccttcatcatcccattgaatggaatctgaatttgacaggagcatctctagagagctgtatagttcacaaacaaaacctaaaaagttaagagaaatggaatgcagtttttcttgtgctatccttattttatatatcaatatcctttctgttgaataataatcatttatccattgatcttgaaatagttcacatcctgcaatttctttatgttaaatcattagtattaaaaaataaaataaaattttaatcaatgatttagtagggaaataaaagggacactccaagcatatagcaaggggtgttatctagtctaaggaagtaaaagaagtaggcttggagggtgtgatggatcagctgagacctgaaacttgactaggaatttactcaggaatggaagaggctataatatagttcagaatagggaacagagtgtggaaatgtgtccatagaggcacaggagggctgagaaggaaaacatacaaagcaaagttgaggttgtctctatttgagcccaatggtgggcatggacagatatggtagtctccttaaaccttaataagatgctgagctccatcctaagacgatgaaaaaaatcactgaagtgttttaagtatgaggaattagtcacagtacctgcctcttcttcctaaataaaaaataagctccaaagtaagttgggatagcagaaaagttggaaaaatcttaattatacataccatgctgctaactgtggtatttagggaatggaatctagtaggagagagattttattttaagtacttttctactattcaaacatggattattttgtaataaaaaggtattttaatgtaagtttaagagataataaagcattgtcccctaactgtaacatttttaccaaaaatgtcaaggaaaggaagaagttcaatagaattcacagaaataatacttatctaaagcaactgcctttgaaacttaaaacagcaaacaagaaaacagaaaagtcagatgtctccttccagtgtctccccttttcatgtattgatactcaatagtttcttgcattctcaacaacagagaattgaacacagttttgtttgttaagtttgctgcatttttgagtgtagtttccattatcattttgaataaaacatctttccttaagcaaaaatgtttctgaaattattatgcaaatcaataggaaaatacaattttcttagagaaattctgtttttcacatttttcaggtttaaaaagcctaggctttaaagtggattgcaaaaaaaaaatgaacaggtctcttctgtatctatcatatatggtagctgtgttagtcaggtttctgccgccctaatactgtgtaacaaacaaccctcaaacccagtttcttacaactgcaaacatttgtaggtttgtgggtttgcagttcagttgtggtcttgctgaccttggctgaatttggctgagcaaagttatatttttaagctttaggcctagatatatttatgcttttgtcagattcaagtccacttcatgtgtctttgttctgagacttgggctgaaagactaatgactctctggggcatgcttttcccacagcaaagggcagaaactcaacaggactggtgaaatgttacaatactcttaaaattatggcttagaactggaacacagtcatttctgcccactgatcaaagcaagtagaatggccagcctcaaagtcaatggggtaggaatgcatactgtccctccacaggaggagtcactaccaagccaaatgacaaagggcatgaacagttctaccctggggagaaagtgaggcattaagagcagcatttctatctaccttggtggctgaagtatgatcaaatggaaatctacattgttttccccacgtagatttttccggtgtgcaagattggaattccatagccactgagaacaaattaaaaagatgagactaaccagacaattttctttgcaaatatgctgatgggatatctgatgacaattgattcaacatcaattgctatgcaatcgttatgaaagatatattgtactaaaaaaatttaactaaataatatggaagcaatatttttgttattgttgttgttggcagggagtacataatatctatgtaagaaataatgtaccttcagacttccagcctccagaattgtgaaagaatccatttctgttgttgtaggccacccagtttgtggtactttgttatggcagccatagcaaactaatacattagctttgcaacttaggacaaaatacttcaaagtatgaagtcttagtttccttatctttaaaatggcagtgacatcagtagctgtctcatagggttggtgtgaggttttgttggtaaagtgtataacatagagaccggcatataggaagtcttccctacaggtgtgtgagcgtcatcatcgtcattatcagtactaactagtaatagttgtcttctcccacatttctctgtagtagtcagtttttcggtatgcccatttaatttcctgtaatcctgtttaaagtggatatatcccttacatgcccatccatgtctgggtcctcacatgctgcttcagtgttctcttcatatcagaggctgaatgtatgcttgaagaggttgtgactatagccttaaatagcccagagcatttggaaatgttctttcaagccttactctaatttggggtttgccttgtaatatatgtgcatttgtttaaatataaaaatggatgtttaaattactacttaaaatgcttaatttctttctaaatccttaagggataagtctgtgccccaggaaaatacaacataaggcttcttgtgcctttacactacccctacccctggtagactgccacagacttctgggattattggcatcctagattaacagtttgagtttgaggacttcttgtatataggtgcttatgatcatgtcttatctgaaattcgacattatgaccattctgtctctaaacatcagtacctctagaccactggttctaaaccaggggtaactgccccaccgaaaggacatttggcaaagtccagaggcatttttggctgtcacaacctgttttgctccttggcatctggtgggtggagaccaggaatgctgttcagtgtactacaaggtccaggaaagacacccatagcagaaagttattcagcccaacttgtccaccatgttaaggctgagaaatcctgttttcagccatccctagtatgatcacgctatgtttgaatatatcaggccacagagatttctacttttcattagggttcttataatataatattttcttttttcttttttcttctgtctttccacatagatccatatcatatatgtctttgtatttcctttaactctcagcacccaccctggaaagtagtaggttcttgataaaatgtttacggctggaatctactgctgtgaaaatgtcttggacccatgtcacttataatgtacatatctaaaaatattttctctcttcttctggtctcaatagcatcagaaatgtatagagttttagagacagctgggcttttagaaaatgggccacagatcacaaagctgaggttttgagaaataatcctcatctcaggacaggtatatattaagtggatactggtcaagaatcagggtcctagttctgccctttgcatctgtgtataagcagctcccatccggccttgactttcttctgttcacgtaacttgtaactttcccctaagtcttcaaaagtggtaaaatggaaatagtatgttcataccaatgggcaatttgcatttagttcattgttctgtgtctacagtcctcctggaagcattttctaacggtctcagattttctagatttttctgaccaaatactgaccaaatgtagcaatcaatcaatcaatctatctatctataaattagtcaattttggtgatacttatgtgggatctatatttgttctgattcacctgctttccaatgtgcactcagcattcttttagttgaggaaatgcagttcaaattactataaggaaaaataaagggaaatttattgcctaaatattttcaaagccccagagtattgcatatagggagaaaaatgatgttgtcatatttctgcctctcattcttactcctgctctatttttctgtgttatatttcatttgtgattggaaccaaggctcaaactgctgttgttagtgctccctgcccctgtccatctcacagactggctctttcactatgcagaaagatggccaccatccatgcctgctgagtgaccatgccccatagcttctttagaacagtcctaggaagaattttaattggccctgtttagctcatttaccaacaactgaactaatcactttggccaaaggaattggattatttgatcagagccaaccacatccttctggccattgaaagtggagatagtctctgccaactgcatggaatggatttcacagaagaaagaggtattttgttaccaggataatgtgtgagaagacatcctggacaagaaaatatagtagaactccaatatattagatgacctatcacagcctcaacatgtgtcactttcttctagaaggcctagaatcatgctttagacatgctttaaaccccagcagtaattggtaaatatatataatcaccaactgaagtaaatgtgtagtaatttactatgttaagtattgccaatacaggtttatttagaaatatttgccagctttcttttatttagaatgatttgcccgtaaacagaacatttatactgtgctaaaatatatattccctgagtatataatattgctttttaaaataaaattatgaaatgaaagagaaataagtgggtatggtatggagtatttgcctttataagatcaggtgtatcttttagaattacttgatttttacctggcaaattttatgacagttcaatcagaaggacaagctcctatggggttcgggaaatgcaatgaaaattccaccaggcaacattcagaattcaggaccacggtggctttattctccatatcagtggcaacatctaattataaagaaagaaatgtcaatgccttttttttttaattgctggctggtggttgtattaaatctaaccttagttgacagggactactcaaaattctctcctacagaaatgtacaatcgagcaaagcatgaatatatctttgtcaaaacagcaagcaggagcccttgtttaaaaacttaacaaaagtaccttcaggctcaggctctgatgatacacttagttgcaaattcactggtgagaaaaagcatttggaaagctaagatctgtgaggtatatagtgttatttgtcactctgcgtttaattgttcctgtatataggtgggttggaagtttctaagacttgaattgtatgtagttaaatataatgtaactctggtcctgctagaatgtaagttctgtaggtgcagatatttttgtctgttatgtttactactgtaccctcagggcttaccatgtaaaagttgttcaataaatactcatttaatgaatgaatgaattggggtattagtcgttaaaaatgaaaatctcaatttctaaagttttgccttttccagaaagtattataattgaaatcatacaatgtggagccttttcagactgacttctttcacttaataatatgcatttaagttttatccatgtctgtttagagcttgatagtttatttctttttagcacgtaataatattccattgtctgggtgtatctcagttttatctgttcacctactgaacaacatcttcattgcttccaaattttggtaattatgaataaaattactgtaaatgtgtgtgcaagtttttgtgtggacattagtttcaaatcctttgggtaaatatcaaggaacacaattagtgaatcttatggtgagagtatgtttagttttgtcaaaaaccaccaaacagtcttcaaaagtgtctgtaatattttgcattcccaccagcaatggttaagagttcctgttgttccaaacatcctcacccagcatttagtgttgtcagtgttctgaattttggccattctaatagatgtgtagtaatatctaatttttttttaatttgcatttttctgatgacatatgatctggagcatcttttcatatgcttatttataatttctatgccttctttggtgatattttgttaaggtctttggtccactttttaatcaggttgttgattttttattgtttaaagagtttgttttacattttgagtaacagtcctttatcagatatgcctctacaaatattttcaccaattctgtggtttgtcttttcattctcttgatattaaaaatatcagagaatggacatttttaattttaatgaaacccaacttatcaattttttcttttatggagcatacctttgctgtcatatctgaaaagtaatcaccaaacccaaggtcatctagaatttcttttatgttatcttctaggatttttatagctttgcattttgcatttaggtctgtaatcaattttgagctaatttttatgaagagtataaagtctgtgccttgattgattgattttgcacataaatgtccagttgtttcaatcttatttgttaacaacactatctttctctattgtatttcctttgttcattgttaaagatcagttgactatatctatttctgggttctctgttctgtgtcaatgatttatttgtgtattctttttaccaataccacactgtcttggttactataactttacagtaagtcttgaaagcagatagtgtcagtctttcgactttatttttctccttcaatgtcgtgttggctattctgactcttttgcctctccatataagcttcagaatcaatttgtcaatatctacaaaataattttctgggattttgactgggattacattgaaattatagatcaagctgggaacacctgacatcttgacaatattaagtcctcttttccatgaatatggaatttttctccatttatttagttctttaatttctttcaacagaattttaaagttttcctcatataaagatattttgtgagatttgtactaagtatttcattttgggggatgctaatgtaaatggtattgtgtttttaatttcaaattacacctgtttgttgctggtatataggaaagtgattgacttttgcatattaaacttgtatcatgtaacctttctataatcccttattaattccaggtgtgtttttcagttaaatcttttggattttctacataatcatgccatttgagaacaaagagttttatttcttccttctcaatcagtatactttgcttttcttgtcttattccattagctaggacttccagtatgaacattgaaaaggagtggtgagaggcgacacccttgcattgtttttgatcttagtgggaaagcttctagtttctcatcactaaatataatgtgagctgtaggtgttttgtacattttaaaatcaagttgtacattttaaaatcaatttctagtttactaagtgtttaatcataaatggatgttggattttattgaatgctttttctgcatctactcatatgatcatatgatttttctttagcttgtggatatgatgaattatattaattgattttcaaatattgaatcagcattgcataccttggataaatccctcttgattatagtgcataattctttttatacactgaatttgattggataatttcttgttgaggatttttgcctctaagttcatgagagatattggtctgtagatttgttttcttgtaatgtctttgtctggttttgtatttgggtggtgctggacttattaaatgagttaagaagtatttcttcagcttttgtcttctaaaagagattgtaaagaattgatataacttcttccttaaacatttgatagaattcaccggtgaacccattgaagcctggtgctttctgttagggaagctattaatgattgtgtcaattgctttaatagatatcggcctatttaaaatgtctgtgtcttcatatgcaagttttggcagagtgtgtcttccaaagaattggtccgtttcatctgttattaaatttgtgagcattgagttgtacacaatcttcctttattatactttcaatgtacatgggatctgtagcatgtactaatattaaaaatgaaaggacatcatttttaatattagtagtttgtatccattctctttatcttcttttttttaaaattagcctggctagaggattatcattttaattatcttttcaaagaatcagcttttgattgaattgatttttctctactgatttcatgtttttaatgttattgatttctgctttaatgtttattatctcttttctgttgcttacttgggtttaatttgctctcctttttctcatttactaaggtagaagcttagataattgattttagatcttttaaaattttctaatatatacattcaatatatgcattcaatgctgtaaacttctctcttatgtctgctttgactgtattccaacaattttggtaagttgtgtttttgttttcactcattttatttagttcaaaatattttaaaatttatcttgagatttcttctttgatccctgtgttatttaggaatgtattgtttaatctccatgtattttgggattttctagttatctttctgttattgaattttagtttaatttcattgtgatctgagagcagactttttataatttatatttttaaaaatgtgttatagtatattctatgacccagcatgtggcatatctttgtgagtgtttcatgtgagttggagaagaatgtgtgttctgctgttgttggatgaagaaatctatagatgtgaattttttctggttcacttgtggtggtggtgaattcaactatgtcctttctgattttctgcctgctggatctattcatttctaatataagggtgttgaagtctccaaccataataatggattcatctatttctctttgcagttctgtcagtttttgcttaatgtattttgatgctctgttattaggcacgtagataaagattattatgtcttcttggagaattgacttctttatcattgtgcaatgtctctctttatccttggtaactttcatgcattgtagcctgccctgtctgaaataatatagccactgtcttagtttattttatgtttctataacagaatacctgacactaggtaatttataaagaaaacaggtttatttagctcatggttctacaagatgggaagtacaagaagcatagcagcagcatctgctggctttgggtgagggctttctgtgtaaaagttttttgtgctgtgccataacacgatggagaatgtcagtggggaagctgacacataggaagaggcaaaacccaagaggcatcctggctctgtaaacccactcttatgggaaatcattcattcctgtgagaattaatccagtctcaccagaatgagaactcaatcactactgcaaaaacagcaccaagtcagccatgaaagcagaagcctcatgacccaaacacttcccactaagtcccatctcctaacaccacctcattggggatcaaatttcaacaaagttttggtgaagacaaaacaaaccatatccagaccacagcagtcacacccactttcttttaaataatattagcatagtatatttttctccatttatttttaatctgtgggtatctgtgtatttacagttggtttcttgtaaacaacatctagttgggtcttgttttttatccactctgacaatccctgtcttttgattggtatatttagaccattgttgctcaaagtgattgttggtatactttcattaatatgtaccatatttgttactatttctatttactgtttatgttctttgttcctatttttgtctgtgactctttttctgccttgtggttttaatgatacatattttataattcaattctctctcctttctttagcacgctatactaaagacttattttataacttatttagtggttatacttcttttttcacttatttagtggttattctagagtttgcaatacacattcacaattaatcaagccaaattttaaataacaatataccactttatgggtactgtgagtaacttacaataacaaaacaatactaatttcttcctcccatcctttctatcatttctctagtgaaatttacttatatataagcaaaaataagtattagatatcctatatatggtaatatgagcatatgtaattgatatgttgttacttttattttgaataaattgttttctgttaaatcaatgaagaataaaaaaacaaaaatttttattttaccctcacttagtttttcttcaatccttgtcttttcttaatagatctttttaaatagagtttctgacccatatttcttctctctaaagaacttttaacacttctttaaggcatgtttgctgactaattccctcagtttgtggttgagaaaaactttatttcttcttcactttaaagaataattttgcagactacaaaaatctacacttctgttttttctttcaacccttcaaatatttcatttctctctcttttttgcttgtgtagtttctgaagggaagttggtataattcttatctttgctcctttgcaggtaaggtgtcttttccttctaacttctttcacgactttatctttccttttctgtagtttgaaaatgatgtgcctaggtgtaggcatttttttcttttctttttaattctgcttggtgttttctgacctttctggatctgtggtttggtgtctgacattaatttgaatgaaatttgcagtcattttctgtttgttaattccagcattcctgacatgtctgtttctgatgcttgctctgacttttcaaactatgtgttttgtcttttagtatgccttgtaatttttgcttgcaaaccagacattatgtactgggtaaaaggaactgctgtaaaaagatcttaataaggtggtggcagagtgtgagaagaggggaagtgtcctatgattgggtttcaggattttagtaagcctatgctctgtactgtgaacttcatgtttttcagtttttttccttcccccttgggtgatcagagtgagctggaattggtatttatcttttctcacatgcaaaacttgagctgactgaagttgggtactgtcctttccccatgccagttaggctctgataaaaccccatcaagttaggctctaggtaatgagtttctcctaatggtatacttggttaagaacatagtgttctggtatatttcaaaatggttgcttttctccctctcctggttggaagcaccaggagatttctccaatattcactgtgagaacctggttgagttcctggaggttaaagtcacaaaaatgtcaaaggccccccccaccccccatgaccacatccccttgtagtttttagctctcagacttgtctacaccaacccttcagcaattcattgattacagtaaaggttttcctacctagcacttgttgctgggagctttttgccctggtatattgtgattctctgtatccacctatctgtctttccaattctggggacaggattttgccctgtgacctcatctgttttatggacctaaaattagtttgtgatttttccattcgttgagctttttacttgttgtttgggtgaagtggcaacttccaagcttctaagatgtggaacatgaatccagaagttcctttctatttttgatttctactctcctttgggctggcttaattcttaggaacttttcatctggtagcagagatgatcatgggaaagccccccacttacactggccttttggttagcaaccccagaaaaattagtttaaccttccaacccctttgtccacagaatttccaaaagtgattgattgttcttctttgatgatgtgctcagctgtggaccaacagttgtgtcctgagggagggagggagggaagggatttttttatagatagttctgaatcacgtgcctttgcagaggcgaagaaggcataagcaggattggcagcccatgggactcatatggagtgaaaatggggctaatcccaaaagaaaggagagattaaaagcaacaatcacaaatgttcaaatattcactatattgtatctaacaggcttcccatatagagctctaacttattttaatggtgaaatttttcaactccctttacggggaaactgaaattctcaaggctgaagtgatttgctcaaggtcatccagcgagttaatgactaatctatgagataacaaagatatacagttacctagtctacagcctgttctcactgtatcatttggcctcccagatgtcctataaacccacttcctttttttcccttttacatcaagcataactattcccatttagtaaatcatatcctattatagaattataaagtagattggccaattgcagatctacatacagtgtaaaactgaccttgaatgtaatgtgttggaattccataacccaggtaagcccgagaaaatgaaccatgacttttaatagcactgcaccacaaggattatctgaggatgtcttttaatgtattctataagacaaaggtgatttttaggcatcacacctttccagagatgatttaaattcattcaataacaagggtttgtgctttatgagctgaaactcttagtcgataaacccattggaaatcattacaagcactgaggtcctggttatgttcatttcagaacccctcttaacagtgtctcttttgcagccagtatacacggtgatattctagatcttgtcctcacaactttatgaagaagaaaatgactacgaggggatatgaggaatgaaaaagaacatagggccaggtgtccatcaggactctgtgaccctaaggaaggcacaaattctctcggtcccactttccacattggtgaaatgtggatatttagagctcaaaagcggagagattctgacagtatttgatagctatgttactacaatgcgacaaaagtggactgagcacgaccttcaactcctgaagactagaaaacgtccctagatgatctttccttcaactactacatttgtttgcaattggcatgaatttccatagaaatagactattaataaagtacaaataagtagaagcggtgtcccagaaaaccaacattgtcattcacctaaggatggaagaaggaaaaagaacaattagtcacaaaattggtcttctttacactaatatgaaaatatattaggtagcaaaatatttacataaaaaagggaaaagttaaattttatatggattttctcttcagttaactgagctttcaggagatgtgcaaaaatactcagtggttataatgcattagaatttattgcagtagaaatgaaagtatagtcaccatgacatagtcacccccgattaaagatataacctaaaattcctttatcgttccatgtgtcatgtggagattaaaatgatttttaagtgtttttattctttttttgtgtgcttcattttaaaaaccacagatttacacataaaaaaccagcagtctttggtgaatgctaaagaatttgggggtaggttttaaactatgtcaatattatgaaatagtttgaaagagatatattatgtgtttattaaggggatggaatgatggccgatttgaatttacttctatatcaatgtagacaatctgatactttgtcagaaaaaaaagaatatgtagaataacaaccaatggcaaacagataatagcatgttgacagccttaaaatgagatagatgttttcttttttctctctttaatatgtctctgatttgtcataaaataccataaaatattgtcacctacatggtgatattgttactcatgttttataaaaaatataatagttcccaaatgatattattgaggtctctttcagttatggatataaaaatcaatttaaacggcttaagtaaaaaagaggatttactgacacccatatgagaataaaaaataatgatgtcatggcttcaggcacagttggattcatttattcaatgtcaccataaattacactttctctctgagctctgctctcatttggattggtcatatctggcaaaatatttctgtgtgcagacaagagagcgacccctagcttctgattcacattctatcatcttaattaccttaagcccaagataacttttttccaagtgcttccgagcaaagtgttgtagttgtacctcattggactaacttggactgcatgcccagttaccctagcccggagaaagaaatatgctgattggctagacctagtcacatgatctccacagatgctaggagctgaggttaatcacccccacagcacagtgatgaagagtagaaatgacttgacactccccaaagtggtaaggtgtttttaccaagaaggtggtgtaattcaacatcaaaaagttccctaaatattatatatgtagtaaactaaatgtttgaagtcagagttaataatatcaacttgcctggtaaggactaccctgaatattatcaaattgaatgatgaatagtttttagaaagcagtatttttcagccctatattagcaaaaaatggagatactgctttctattgactaatatggagtgacattttggtaaccaagacccataaagttactgttttctgaaattttcttattcttgaagcagagcctcaagatcctacacattatgctttttaagtgttttccagattaaatgatatcaaaatatcgtagttaattggtgctatttttatagaccatcagaaaaattcataaaagtgaaaaatatgaccacatgttacctgtgcagtagagtattgtctaaccactggattgactatttttaaaattttgttagtgaagtgagaaacttcacagagtagacagtgatcatgagtgtgtcatgtcagttcgcagagccccacctcagacttacacaatctgaaactctgagggtaagtctagcagtcactgtttaatcaagcctaccacaggattctgatgcatactaagatttaagaactaccaaatgagcattgacacacagtttgttgtcaacaattttacagcaataaaaatttcattaaaatatctattctgatagtacttgcactagtaatagtagttgtagtaattactaatgtttattaatcccttactatatgtcaggcactgcatatctcagttgatgaccacaactctagaaattagatgcccttgttattcccattttttgaaagagaaaattgaggatgaaaacaaagtgcttagtcaaggccacacagtaaataaagaacgcttccttttattaatcaccagtctcattctataattttggcaattggaaaagtaccttctgcaggtagcaatggagtaacaatagactcagagacttagaaacaggaagacccttcactgttttgctttacattcatttgaatgtaaaccctgtctgtttatatttttcattgtatgaaaaaagagaagatgaggttattttttaaaaaccttacagtatttttcttgataagatgtaatcactgctgtatgaaggatatggacgtttggaagctattccttccttctgcctatgatccatgcaccagtacaaacctggtcattttatttcaataacatgcagcatcagcagagtccattgtgcgtttatagccttagagctcgtcgtgttgattggagtcgtgttttagccaggttcctatttctttcagctaagtagttacagcaagctgtaacttcatgcgacaagcctggacatagcttttccttttggccccaagaaacttctgggatgcattttctgtgtatgtagggtcccaccagatttaagaaaagaaatgactcatttttccaccactgcatttttgtagtctggcttatgtcaccaatcaggacaaggctactcaatctggcttcttccattaagggactggctctaacatagagccttctggtttttgaaccaaactcagatccagcaaggcctcattctcattttggcaagaaagtaaggccagttggcctgaacaatattttaacctctatcttttcagggccccagggatttcatctccccacaggaaaaaaaaggaccaagccaggccttcaggttgtttgcatatgcctgtagctcaggctgccctgctgtgcagaatttcctccaagttgtatgcttgggtggtaggcatggatctaagatgcccccaaggttctcactacttagtgtgctctgaataagcgcctcctcttgagtgtgtgcaggcctggcctaattaggtgagccctttaaaaaacaggtgtaatggaagagacaaaatgtctaagaaattccacactgcagagatgtcctctctcttgccttggaggaacaactgccatttcatggatggggccacatggaaagggcctgcgagtaacctctgggtgccaagagggaaacccacccaatgactagcaaaaaaatgggatgattggccatacaactgcaaggaaatgaattctgccagcaacctgaggggttcagaagcacatcttcacttagtcagtcaagcctccacatgagaacacagccagctgacagattaatttcagccctgtgagaccttgagcagaggacccagctaaaacatgccagcctcctgatacacagaaacagtgcagtgacaaatttgtgttgttttaagccactagatctgtggtgatttttaaattcagcaatagaaaactaatacagcctggaacatgcctaaccttccatgcagaatattacattatacagcagtaatttccaagactgttagataaaaaatggataatgtggctctataacaaatggaaagcaacatagaaatgttgtgattcttgtagacaattaagttaagagggtagcatatcgtattatcattgtcccttcttgcttcttaaccagtttatttgctgtctcccacatgcattattacattatatgtgttctcagcagtttcagcctgtgattttctggcttccaatgtgtttagacattgactcaaaattgcagtcataggttttgcttttttaaattgttaaaatgctatcattctatcaacaaatactacaacattactaaaactttttttcattatattgttcatgtttgctgttaagttagggaacttatttttttctcattttgtaatacaaatacagctataataagaggcataaaacccacacaatttatatatacttcattgtctcagattgaaaatcaaaaatacatagttcaaatctatagatgtggagcccgtagtagctgaaattgtgggcctatattttaaactcatcagcatcacttttaattttttttcctaaacacagttaaacatggtctgaaagtgccaaactccatcacaatttttttcccctttttcctggcccgggtttgtaatgagcttgtgtttgagagaaagagaaaaggagaaaataattggaactgtctctcgttaccactaactcctgtttttgaaggtttttctattgtttaacaccttccatttgttttaccttagaagcgtgattcagttatcaaaacctgaagaaaatgaaatctaacttataaggcttcatcataaatatggtgactcaagtcaggaaaaccaagctgtctgaaggcctggattttagattttcctctgaaatgaaagttggccctacagatgcctctggggaccatcctgacaggccaggtattctcaccatggttatcagtgtgaatacacataagctcttgtgatcaagggctttgctagctgctcatccattaggtaaagtctggtgggtatagacttgggacttactaccaaagggatcatatcctccaggattacctgactcactgaatcatctcaaagttccaatgtttacccttcagtctagcataatgaagggaatctgttttgatgtgcaatacacaatgtctcaatttctcagagctgagaaagactataaatattcaacagtcttttgcctaacacgtgtacccattcttcccaagctctattcagtaagccaccctactgttgctgctactactgatgcagctcctgctgctagttaacctttttgtaatgtttactatgttccacacacttggaggtagtatattggttatctattaccacataacatataaactccaaaactgagcagctaaaacaagattgatgatctcacacagtttccagtactggctttgttgggtggttccagctgtggtcattgtctcatgatgttgtaattcaaatattgcctgtggctacaggcatctgtaagctttatgggactggaagacccagtgctaagacaacccacacacttaacttgcaaggagatgctggctattgaaaggagacctttgtcccttatcatttggacttctttatggggctgctagagtctcttcacaacttggcagctagcctcccccaagcgagtgatccaagagagaacaaggcagccttagctgtgtattttatgacctagcctcgaaatcatgcaccatcatttctacaatatcttatcggctatgcaggttagtttcattcagtgtgggggaagactgcacaagggcatgaataccaggtggcaataatcactggtgcccatcttggaggctccaatatgtaggtataacacataatttatacttacaaagtgtatattctatatgctattctcaactattaaatcattttcctggtgtgaaggatatatttaagagagaagattctaaacatactgactaatgccttcattttcataatgattccgtctgaatttggatatttgaaaatatttactgacattctaccatctgctagtcacccttctgggtaccaaaaatactgtggtgattgagatagacagaatgacagccctcatgaagcatatagtctagagtggagaaactctgttttagtccatttgtgttgctataaaggaatacttgagactgggtaatttataaagaaaagaggtttatttggctcacagttctccaggctgcataagcagcatggtgctggcatctggtgaaggcctcaggctgcttccactcatggcagaaggtgaagggagctggtgtgtgcagagatccataaagagaggtgaggcaagagagagataagaaagttgccaggctctttttaacaaccaccttttatgggaactaacagagcaagaactctggccattgttcacagtgacacagcaccaagccgtttatgaggaatccaccctcatgatcaacaactctctttaggtcccacctccaacagtgggaatgacattttaacattaggcttggagggtcaaatatccaaactatatagcaaactctaatcaagtaaatagactgccatgagcttcataataaagataaaagcattgagatggaaaataagtggtaagtggaggttacctaggatagggtagccacagtgggctttcctgaagagacagcatttgactcaagaacaacagcctgagtatgagcctgtaatatgaagacgggaagctgcttggggagaggaggggcaaatcagaccaggaaagagactggtctgttcaagacccgaaaaaaaaaaaattagtgtggctgaagcaaagtggagaggagaggggtaagagatgagattgtaatgagagaaaaaggccagatcacatagtgctctgtgagtcacttctaaatttaatggcagccattgagaagtttttagtagagaagcagcatgatattctttgtgttttgggatgctcagtcttgctactagttaaaaaatagagggtcagtttcagctgctattatctttgttcccctttttgtctccttataggtccggatgactttggctttcaaatgagacatcttccccctgcaatgagcagtcacttttctttcctcccactaaacattattaaaaccatgaatcactcatacagtataagtgtgtatccattcacctttttattacattttctcagcttttatcccctttcagaattgtactttacctgaaattccttttcttggtgttatccatacaatatgccaatcagttttttaaaagtatgtctaaataaggccagccaaggtgaaaagttgaggcaatggtggtcagagttggagaaaggggatggttgccatggaattattcatccctgacccatgtgcgatctttacttggtgctgcactgacacactcagctatgtggttgaatcacacactaagctgctgggtgggattgtagcccacggtcccagccaaaggaggaaaagtcatctttagaaactctcaggatatgccacattccctcgcgttaaccctcctctgggcccagctaacttaacttacaaatggtggtatttttttttttttaatcattttagagagagtaaaaacataacacaggtagtgaggttattagctcctctgcacttcaacagaagtcagtagttgattctgttggatgatataatcggttataacactttgttgccagtaaaaaagaaaccaactccagctaatgtaagtggaaactgaatttattggatgactaccaagagacttgaaaaattgaaggaaatgttggaaaaataactttaaaagggaaaaatcaaactgtgtccataatttaagacatagcacccagatctagctcatagtctcttcaagttgtcacttctggaatgaatgaatgtcatcgttattttcttgttgtcttttttcccttttgcatccttctgcttaatattaaaaatctcaaaagagagctcattgatctggcttggctgtatgtagttaagagaagtaatatcccaggaggaaatcagagtgctattaccaaaagtgataccttccctttactttcatgtattcttcccccaagctccctgtggagtcagggggtagggcctggagtatatgaaagatattagatcttcggagaaatgtcatcaagactgtgtggattccataaattccacacccagccaggaagatgcacaccttacgtgttccaagtaattttatcagtatattacaataaatcacatgccacatctttctgcataatgacctccagtttagtaattgcactcacagtaaatgtctgtgatcagaaagtgtacccagcttagaacttcttaccattggagccagtgggaaagttctgcttaaagccagtagagcctttagcacattcttccaatattgaatcaattcaaccttgactttcataaaaagttatttgatttttgcctgccttaacctcagatggttattatacacacaaaaaaagactatatacagaagagttaactacaaagtaggcaatatggttcccaatattacctatgtatatatgtgtctactgcagtatgccactgggctgtgtcaaagctgtttctcagttaattttgagtaccctagtaaaacacattagtattggtttcttggatttgcttgttagaaggaatggatcagctgggatattggtcttttccttgacatacatcaacaactcttgacactcaacatggtccaaatgctttgtctgtccttttcatgctttctagttatcatagaattcaggcatttccttaatttgccaagcacacttgaaacaatgttatttccttattaaaccaatcaggaattgatctctgagtatagaagctgtgatgctttgatactctcctggccacatggcatagatacagcttttaatatagtcttctaaaattctcccattcaatttcttaggtactataaggcctttccctttgcacaaaatttggtgtgattaagttctggccacctaactctgtgatttctattggttggaggagcatagtgttcgagagctcaggttcctggttcacagagaccagagttcacactctcatgccgtttctttctcactgtgtgactttgagcaagttccttagtttttctgggcttctatttcctggttttcagataaatataataataataaatgaggttaagtaggatattatgtgctaaattcttgattctgtgtctaacacaaagagctcacaaaatgttaacagttatcatcagcaactgcagtttgccctttcaaactacctcctcttacatatactgtatttggttattcattacattcaaaggagaatttattgtccctgttttttaaataatacacatcaattttttttaagtgggaagaaaagagagaccccactgagtgagtggggagttccccacaattttagtccaagtgtcttaataagaaagaaagttgcacttttgcttagaggttgtatatactgttgctgatctgtgaaatgaaggacactcagatttctgcattatttaatcatatcaatataaagctccataaaactactttaaattcaatgaagcatcattagcccagtatgctaaggaggtttcactgtgaatttatgcggttataactgaaatcaaaacctgacataatgtatatgcctaagaggaataataagaacaataataataaatagatcatactcaatatatgccaagcactttccatgcattattctatttaatcttcacactaagcagtgtggtgcttaagaagcataaaaatgtggtgagagtacaggatttggaggtcagacaatctaagctgaaatttaggctatgtggcctttgcccagttaatcttcacgtcccaatttttccatctgaaaaaataaagtatataatttctgaaaaatggaaggttagagaaaatctaggtaatcttgcttggatttggtgacaagtctttagatacaacacctaaagcatgactcatgaaagaaaatatcaataaactagacttcattaaaaattacaaacttctgctctgtgaaagatattgttaagagaatgaaaagacaagccatgactggggagaaaatatgtgcaaaatacatttctgataagggacgatgagccattagaatgacaaaaatcttaaaaactggcaatactaaatgctgacaagaatgtggaacaacaggacctcattgttgatggaaataaagaatggtatagctactttagaagacagttcggcagtttcttacaaagctaaacataatcttaccctatgatccagcagtcacactcctagctatttacccaactgatttgaaagcctatgtccacacaataaccctcacacacatgttcatagtggctttattcataaacatcccaaactgtaaacaaccaagatgtccttcaatcagtgaattgataaacaaactgtggtacactcatccagtggaatgttattcagccaaaaagataaatgagctatcaagccatagagagacatggaggaaacttaaatgcatgttactaagtaaaagaagccaatctgaaaaggctacctactctattattccaaccacaaaacattctggaaaaggcaaaacttcagagaaagtaaaaagattagtggttgccagaagttcaggaggaggcaaggttgaataggtggagcagagaagatttttttaaagcagaaaaactgctctgtacgatagtctaattgtggacatatgacaaaacgcatttgtcaaaacccattgaacttgaatgcacatacaatggaccttaatgtttgcagatttttaaaaaccgttttcaagaacaggggaatcccagatgaatgcagaatatgactaaaaatcctaattctattaaaatatataaaacaccttcactgaaggcagtgggggaaaacaatgctgactttagtaattttggaaatgtgtagtctgtaaaattaaaggaaaataagactgtgcataagcactgagattgggttgataaagttgtattccacaaaagcatgggttaaatgtgtatatatgcggcattgttatacacgtatatttccttgacatagcagtgagcacacttagtgcccagatcatagtttccaatagtatgactcaattgtaaagaccagagatttttggaaaattggataattctaggaatgggacaggaaatacataagatgagtctggagcatcttgtagtaccagtaagcaagaaaaggctcaaaaaagacatcactccataatcgcagagtcaaagggacacgggaaccaactgaagagctcccaagagccagcactggagcaatgagcaacaaaatgaataaagtgatatgggattataagccaaagtacaaaataaatatccattggctttactgatataaagaaatgatcgaataaataaatggaggagaaaagacaaatctaccatgcaggagaattccaaataatttagattgaaaatctaccctcaaggagggagagcacaactctctgccctttaagtatgaattctgcattgtgactttcttctgaagtgtaaaggatggaaaagtgagtgaggggaagaataactttccaatagagaaacctggcaaagattaccacagccaagttaacacaaacaaaagtaattgcagttttcaccattattcttaatgtaatttattaattacttttaatggcaaaaactgcaatttcttttgcaccaacctaatattatctacccttgatatagtgaaataaaaatcatagtttatctctgtggtcttcctcccccaaacccataatcccagtctaattatggaaaaaaatcagataaatataaattgagcaatgttctataagttatctgaccagtacttctcaaaactatcaaggtcataaaaaacaagaaaaagtttgagaaactgtcacagccaagaagactaaagagacagatggctcaattatcctggatggatgggatcctagaacaggggaataaaacaggacattaagttaaaactaaggcaatctgaataaagcatggactttatttagttaataatatattgaaattgaatcattaattgtaagaagtgtaccatactaatactaatgtaagacattaataatagaggaaactgctgtgtggggatataggaactctgtactcttcataatttttctataaatctaatactgctctaaaatattttattaaatttgagggttagtatgacaattaagataacgtgtttttcaaaccctttatatgtattgatttatttcattcttacaaagacaatctgagatagcacacttactatctcatttagctttcacagtaaatttattttttcttgcctaatgttagattttattatcatcattattataattgaagggtatttagatttgaataaaataaatacctttaaaggtttagaggaacctctgaaattatatactaaatgccatatgctgtgtgccttcctgggaagagcatctgaagcacttcttatgtcttcagatctttatgacaaatggatctttacacaatatgtttcctggagatttaattggcatcccacatgatttgatgtttcaattttccaggattaattcaatgtagaaaattccagcctctcaggtcacagttacagaaattcgatgaaaggtcccaagattttcatttctttgtatttaaatagatgttgatttcagatttttttctcaacatcgactggcaaacagctttaagaaataaatgatgctctaaagtctccatttttatagcatgttttgatgtaatgatgtacttagaaggatcaaatgtaatttcttaatatgtaggttaattaattacagcttttaaaagagagtatattcttattcatgataatccagatttctggcttgtgactgattcccaggtcacggtatggggatgaggaatgagtcgatggggcgtcagtctcacagtcatcaccactccattgtgtctttatatctcatatctttatgtctgtttgtatttcatacctggtcctacaggtatccagtctatgaaagttaataccagtaactgctaccttcaaatactggaaaagcatccagacagaagaaaggtagagcttcttctctggaatgccggaaaacaaaacttgtaagaaagatcaaaatttgcattgagttaaatttctgcttaattaacctgagaaacacattgacttgtgaggtgatgagatcattccttgctaccacccatgtagagaagagtctggacttgggttaagctgaataaatggccactgaatttccatcaagctccaagagaccatagtgttgtttctttgataactttagtttcttactatccgtgaccatcacaaatgtaacttcatttcatcttagctctgaatgtgaaatccttttgagtgtccttgatattgctgaaggatttctaaatagtactactcaattcctaagcattcttttttttttttgaaattattttaaaccaagatgttctctaaaaggatttataacttaccattagaaatcctcttcattgctttttagccttttaggattttgtagggattactaagaggatttctttttatcactagggaaatatggctacagctactatatcttaaaaaaaataaatcttaggcatagcttgacagtgagaaatgcatttatattcccctccagaacagtttccttataacccaaagacactttttaaaagtattttaatttgacaaaaactataacaaaataaaacctagagcagttagatctacttttgtatatagtttactaatatagacattattgaactgaatatcaaaatatagtttagaactcacagtgcttaaaaagtcatgttttagcactctgttaccctatcttttggccttttccaatgcagttgtgtataaacacaggtgtctttataaactctcattctagtttggcctctacatccaggcccatccaatcagctttcttgctggctgttggccagggatcactctcagcttctagaggcagcactcaaggggcccccttttctcacatagggctgtttgctttcttccaggccttccagagaacatgtctctgatgcttcaccttttaaacatttcacctgattgacatttatccaggataatcttgcttttcattaactcaaagtcaactgattagtaacctaatcaagggaatgatatctcattataatcacttttgctgcctacactcaagggaaagagattttacagggtgtatacacccaagttcagaaaccttgggagcatcttaaattctgcctgtcctggatgggtaccaagtttgtctcagcactggttatatgtttgcagattatagttagttgccagaaaaaaataggagaccttatccatattaggccaataaaaacaattgctagacaataatcagtaatcaatacaaaagaaggttttgtcctctccaatcctttgaggttttaatatgataaattggtttataagcttcataggtccccaattaattgtgtaagtcgaaatatgaactgtagagcatggattagacctttgaaacaaaacattcttaattagaaaagaatgtcacttagcttctaaattcatttggttcattaactcaagatgtgaaatttatatgatcactgagatagatgtcctcaaatactttttaattttgtaacaaagatatataaagattgtctgcaaaacaaggctgaatgaagccagttctaaagtgagctctcatggaacttagatgagaaagtgattaattcaagctgaataaaatctcacagataagggggcatttatgctgagcctggaataaaagcaggctcacaactttagcacatattacaactttagtgtgcagttcttttaatttgtctacaattaatatggtcttatttctccctaagttctttagacctactcattagtgaagagaagaaaaaaaaaaactactgatggatgtccattccgatttacagctctgtccaatctgtcagttcaaacaatttcttcggaaggagtttactatcttatacaaaatgatcagtatctcagatttccatcaccacctccaagatactctacaaaatgccatcaggtgtgtgggtaaaggagtttggctctctcagtctctgtggagaagatggattgtggtctttgggtcacagtgttctttggctcatgttcactgagtaatattccttcatcattttcttgctgcactgctgtctctaagggtcactcacagtattcttgagtagatctctttcagcatccctcggtgcatggttctccctatcagactcatcctcagattgtccccactggcaccacagatgcctctgaggattggctgtgatctccatcaagacctggctgaactgggttgctttatgttcccagaaacagaatgatcttacttctgttacagcacccctgtagaagcctccaaccacatccttagcagcttcaagtcccacgggtcacacaagtgtagctcagggaagtaaagcctcaagacttccctctggccactcctctgcttcaccatggcctcccactggtgcaggaagtggcctgtagaccattttggtccagtaacaaatactcttttgtggacttcagtattactgttgctcatctaattaacttttcttactggactttgacctaggataaagaaaactgggacccaattttgctcttcttcccttctcttttctccttcccattatttcttagggtctaaaaagggggggatgggtttgcccctattcctcctcttatctggatcttccctacatacaactctgataagagagtagattggctcttgatatattaaatgagaaatacaacaacttagataatattttcttaagcaaatagggtggcttgtaaggtgcctgttttgcaacaatatcatttttttaaatgtcacagacaaaaagttacctttctcccaatattgtttctgttcctaaattcctaatattcctcctctttcaccctcaaacagatggatacactagaacaactggggtaaaatttccaaaaagtcagaaagtgaaaagagaaaaagcatttttatgttttgaaaatcatttcaaacaaggttcaatagtattgcaactagcagggtatctaggtacagagaatagaatgagcaaatgtactgtgggggagattctcaatgaatatgatctataataaatatgatttgattgtgctatttgattcttttaatcccttcagagacaccactaacaatcacattttgcaaaataatttgaacacaaaaattggatacttatttgtgaaatagaatgaaaatccatggtgtatttgttgaacactgaaatataatagggaatggcacctggaaggtgttttggggtcaactgtggagagcttactccctcaagatgaataactgttggatctgagcagaccaaaaatcctctaactttttcattttattatactttcataattctattgaggatgagaggagtagaagagaaagccttacttatttatgatcatggttctgatttacaagttaaacgttaacacatgcaatgccacccatttttagaagaacaaaaccaagcctaaaaacagttgatgtagtttgtcttgccctttagcgcaaacttcatctgatgtcattgccgttaggttattgttcctttcacaagatgaattttatgccagacaggaaagcactatattgtccttcctatttcctcctctgatatatctttatttgcagagttaaaagtaaggaaataagaattggtcttttacctgcttgtctctgacattttctgagttgtatgaagagtgagaccatttttcttcatatatccccctcctcttgccttcagggttactagcttagttatgtttctacttggcaggtattcaatatctatttgatcaataaatttggttgaattaacttctcaagtttatttgtacaggatctttattccatctcaatgtggcagattaaacatattttctaatggaggatcatcaaccatacttcttaatatgtctgtttttggggagggtggagagtattgtttttatttttattatttttatttatttatttgtttattttgagatggagtctcactctgtcaccaggctggaatgctgtggtgtgattttggctcacaggttcaagcgattctcctgtctcaacctcccaagtagctgggattacaggcgcctgccactatacccagttaatttttgtatttttagtagagatggggttttaccatcttggccaggctggtctcgaactcctgacctcaagcgatccacccaccttagcctcccaaagtgctagtgctgggattatagacatgagccactgtgcctggccagtattgttttttaaaatatcactttctattgaacattcttcattatggcatttttttcccacaaatatgacaatgctttgaggcttgatttcttttttggaagaaagcaagtctttcagagccaagtttggtgacttaggtaggtattcagagtgggtgaacatctttcctgtcaaaataatcagtgtgatttccttgagggcctattaaatgattatttagacacttccaacatacttaaggttgagatcgcttattaaacttctcaatatttccacttatacttgaaaggaaatctctgccaataagcaagctggagttgtcgttcaaaatcgtctttcaataaatgagcacttactatgtttcagattctatgttaaatactttatatacaccgtgttattcaatagtatcactgaatatttacaacaagttaactaagtcatagaaataaaactaacttaaaacaatttctaatttttttcagaatatgtgtgtgtgtatatatgtatgtatgtgtctacgcctgtatgtacataagcctgttaggaccatttttttttttttattatcaccatgtccttctaataaaaatgtaagccttcccagaattttacctacagagaggcacaatatgcaactgtgggaaaccctccaagccttggaagtcaaacacttagcaactcaagggattattccccatgttcactgttgggataaggaaatttagacaagtggcagggtcttttcagtagtggctatgtattcagggccatgatgaatgctgatcaggacaaaagtaatttatggcacacctgaagttattagcaatcttgggctgaaatctgtgactgatcaatgccttctgggaatcaccatgctttattttaatttctgcagttaaaactgaatgcaatgctatacagccatgtttatgtgactacctcaacatcaagtatatgaatttgactaaaccttaatccagattttttgtttatctagaatgcagttaatgagaataaaatttattgagcccagattttatagccaacaaccatgcaagtagagggaaactgctagtatttggtgggggtgggttatttcttcctccctgaatgatgttttctggtttgcttctcacagtcaacttaaaatgtaaaatattttagaaagatttaaatgcatgtatgaattgtctttggtaaataaaggtaaatgtaggcaaatttaagacatccttataagatagaataagactaagaagagtactgacatgcccttcaagtgggtgtcttccacctcagaactctgacctttcccctccacacacctgctgatttagcttttcttcaaggataaggggttacactgatctgtccactctgtagggcccaggctcagacagaggaaaacatagtcaattaataaattttaattctctgtttgtaaaatttttgcaacctattccgaagggcttctaatctcatcttagtctctgtggcaaactttttggctttctagaaatccagaaactagaggtttattaacctggagaattgtgtttgtttcctgaaagctttctagcctgtggcctttcatttgagggaccatacacagttggtagcaaaggtcactggacagagaggctagtgattagagtcaccctcctggttgaagctcataggctctcatttatggcagttcctttcattgctctgggcctcagtttccccatcttttaaattaggcaattacaccaaacaacttctaaaatacttttagctcatataaatagtcaataagagcaaaaggagattctagacttttagttggggagggggttacgagccaggaggtgtgggcctgtgattgcctcccttgctgtttgacttttccaaaacgtttggcttgtggcacttttttttttttttttttttttttttttttgagatggagtctcgctgtgtcacctaggctggagtacagtggtgggatctcagctcactgcaacctctgcctcccgggttcaagcaattcttctgcctcagcctcccgagtagctgggactacaggtgcacaccaccaggcatggctaatttttgtatttttagtagagacggggatttcaccatgttggccaggctggtcttcaactcctgacctcgtgatccacctgcctcggcctctcaaagtgcttggattacaggcatgagccaccacacctggctggctcatggcactttattacttgtttcagtgttagtttatttccctgtgtttaagcctagtgtactctcatgtcaagaggagacatgaatgggaagttttcaacaacctgcaatgtctaatcggaacttgtgcccatttattcgtagcaacttttatagggtcatctatttaaaataaatttacccacaccaaaggaatccatagagagcaacagtcaaaataaattacctaataattcctgcctgtggtggaaatatggtgccacagaaggaaggccagctggcaaccttggagaggtcatgtctcctctcatcttgtctgccctctctaccacaaggtgtggatactgatagtcgtaggaaatatgtatttcctgagcacttactatgtgccaggccctgagtcaggtacccaacatgcagagtaggtagccagagtggagtcagacttctcaggttcaagtcctgtctctattatttacttattataaaacgtcaggcaaggtatttcacttctctaagcttgaatttccacatcttaaattcttctttgtctttattcttacttggaaaattgtgtaatcttgagcatgttttttgaagtctctgagcctcagataacctatctgtgaaaatgaagcaataacaatatctctatctcaggtttgctgtaagcataaaaaaaaaaaaatccatatgaaaacactttgaaaaccatcaatatggagagataagattttgttatacataaatttatagcctgtagttgagacatgatgttaaagagtcatatttcacaaaacagaatattcctgcagcaggcagtcattagcagaattgaaattcaggtccaattttcagagttcagtttacttgttcaaagaaagaccgactgattgatggaaaagtgttgtgattttctcagtctcaagggtctgcctttcccactgttccttagagcttgatcagacaattaaaaacaaggggtcagggtataactgaaaataaaatgattttgtgccatatgccaatgctattcactcatgggcaggctgatatgctccaaagtgtctgatatgctttcatgcctattaacaaagggagagaaacaaccatattatcacaatcataggttttccaccactgtgcttcatgttcaaatgaatgactctcatgtttcttagggacatcattttatatgcatacgtgaattatcaattcaaaatatttacttgccctcctctccactccactctcacatactcccatgtctgtcatgccttttggtgaagttccaatataggagacacaagtggttaatgaaaataaaacttgagataaattctccttggcctcaaggacctaatctgaatggggagaggcagcctcatcattgcttgccctcctcttcttcatattaatgttcattgtgtaacacattttacaaggtactttcatgtatattatactacttaagactctcaaccaccctgagatgtaggcagagcatgaattattagctttcttttgaagtcagacaaatgaaagctcagaagtgatttggctcaagacagagaaccaatagttctcagagcctggtcacttcccagctgagcccccatcctgatgccagtgctttttctccctaccacatctgccaagcacaagcttgggaagacaaaacttgcaaaaggtagcaaccagcaatgagcgccaccaggaagctgactagcagttcagaggagtaaagggtacgtagccttggccgaggggttgtggggcacataagagaagctgatttggcctctgtcctctagagaacatttactattataagggagcccagatgcacacaaatgaaacaatgagctgctgaaagccaagagtcaagcagtcattgttactggggtggattccttaaacatctcaaaatgtctgtttttttttgttttttaacacaaggcaaatatttctagcatatgcaaatattcacataaaaatttgtatttctcgaatgtggattagcttgtatcctagcaatctctgtttaggtttcctctaacaggaatagaactaaaaataaatcatatgtcattagataatctcagagtacatccattaatttcctttcctgctaaaaagcaatgaaattatggtttgggctgtgttgagaacattacatgaaaaatgaggaaagggaatcaagacagattagaacataattatgtgggctggaattcagccagacccttcaaagccttgccaagttggtgacatcctatgtccatcctctaggtaaacctggaaaatgagtacttcaaactcaaaatgacactttccatgtagcaagtctccatacaggcatattggggaaaaactgaatcacaaaagaccacaaaatgcaaagggagaaattaagtgaaagactgaatagaagatggaaaatataatgctgaccacttatatattatggactagactgttggctttttttctcccaactatggtcagagatattaactttctctatacagatctggcttgaatccgtggtgaattcccaaacagggtgtgaatttatcactcaatattgggagcatctggggcttttcattttattaaaatgatttttttcccactacatgtgctccatggagcaaggtctgtacgttataagttaaaagtgattccccagaaggaaatcttttatcactggccgtaacttggagtggagcatatactttattttggaagctgccttgtggagaaaacagcccagggtgcaacttggagacaggttgacaagtgcataagtagcttgtagctgagccctcaggatggaaagatagaacacaggctgtttcggcagatgcatttgaggtttgctcatctgtgaaaactgggagaataaaagtacttactcattgagttatcatgaagagtaaacaagataatgcatggaaagcatcattacatcccctggcatattgtaagccctctataaatactgttctttttcctaatttttatatttttgtttattaatttgttttagagatggggtctggctatgctgcccaggctggagtgaagtggcttttacaggcacgattaaagcccattgcagccttgaattcccgctcaagctatcctcccatctcagcttcccaagtagctaggactgcaagtgcaagccaccatacctggcagacctctataaatatcaactgctatgtcaggcatgataatcaggctcaaaaatatttccgcagaaaatacattattactgtatattttctgttctagcagtaccatctggctgtgtacttttacttctttcatttactcctgctcgactgcttagttattgattttcttacttgtccatctctcctactatactatgaatgtttcaagaactaggtttattacctgttgtctctgtagtcttggtgcctagcacaaagtttagaatttactagttctcaatatatgcaagtttaatggacttaaaagaaacaattctttgcttcttagtaaaaccagctttgggaaatatgccaagactggaataaaaccacatctcatctggtgttgaacttgcaagtgaaacagatgagaatggcacccttcctccacctatattgagcccttgctcaaatacttaaggttaagtgaaggctgaaggaagaaatttgggagaaagcaggagaaaaaagggacactgggggagggatttaaagagcaaagattgctcttgaagaattcattctgcccaagatggttttccactcacttctctgattccctgaccacccaccatctgccccctccaaatatggcatctggctcgacttttaaaaaacaggaggcttcactttcatcaaattcaagaaatcttggctatggacttgtgatttttgaaccagataggcacaatagtcttagcagcattttgtgttggagtagatttggaagtcatagtgagtatttcctcactgattttcttcattggcagtcaagcagataactaagatctgctattgctctttctcatgtttttacaacgttcaaaaataagaattttacctctgtgaaataaacatatataacaaatccttatatgctaggtgaaaaagtagaaattcttgctaagatatcttattctaaaacagaaaaaatacctgctgctttactgtctaaaatgtcatcgctcaaccattttcactggtttgtggttgagatgggattttaaaaatcccaacataatcaaagtagtagcacaaggcactgttttgttttggagtgggcttttttttggcaaatgatgcaaaacacttttctaatgtagaaatgagaaatgtggaaacataggctggaactgtagcatggccaagatgattataacatagttgacgttttcttcacatggttaatcattactttttcgtaggtgggaagaagaaattagactaattaaattgtgatcattgtcatatgaacagctctcaatgtgcattcattggaatgaaatatagttgtcaattctttgatgtcagacctgtttcggattccagtttctctacttacatgtgtagtttaacccccttaaggctcagtttcttcatctatataacggagagatatataatgcttgcctcaaacagccgtttatgacaagtaaatgtgatgatgtatgtaaaatccttagaatagcacaggacctatggtgatggcttaataagtaacttttttttaatttttattttttacttttatggatacacaagagttgtacatgtacatggggtacatgggatattttagcacaagcatgcagtaagtaatgatccaatcagtataattgggatatccatcacctcaaacatttttgatttctttgtgttaggaacattccaattctagtcttctagttatttttaaatatacaacaaattattgttaactacagtcactctatgtgctaccaaacactagatcttattccatccaactatatttttgtacccataacaaacctctctttatccccccctgcaaccccccaatgaaccttccctgactctgataaccgtcattctattctatatctccatgagatcaattttttttaatcccacatataagtgaaaaatgtgccatgtttgtctttctgtgcctggcttatttcacttaacacaatgtcctccagttccatccatgttgttgcaaaagacaggatttcattctttttcatggctgaatagtatttcattgtgtatatgtaccacattttctttattcattcatctattgatgggcacttaggttgatttcatattttgactcttgtgaatagttctgcaataaacatgtgggtgcagatatctcttcaatatagtgattttccttcctttggatatacaatgagcaatgggattgctgaatcatatactacttctacttttaattttttgaggaacctccatactgttctccatagtgattgtgctaatttacattgtcaccaacagtgtatgagggttcctctttctccacatccttgtcagcatctgttatttattgtctttttgataaaagccaacttaactggggtgagacaatatcccattgtggttttcatttgcatttctctgatattagtgatgttgaatatttttatatctgttgaccatttgtatgtcttcttttgagaaatgaatgttcagatcttttgcccatttttcaaacagataaataactatttaattatcattcaatcattatttactgagtgccttctttaatcactagtcatatttagtgtatttttatcaaagacaatgaaggtttttatatgtttacattttttgtttatttaaatgcatgtgtatgttcctgtatttatacaggatatgcaaattgaaaggtccatcctttccaccaagcatagagatacaaatttttgtacacatgtattttttctgacattttattataaacatttaaatactcaaaaaggtagaaaattgaacaaatgaacaactcattaccaacacatagcttacacaattatccttttattatatttgctttaacacatatctgtcaatctacccatgctttaatctatttgatttttttttttttttttttttttttttgagacggagtctcgctctgtcgcccaggccggactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtctcgatctcctgacctcatgatccacccgcctcggcctcccaaagcgctgggattacaggcgtgagccaccgcgcccggccaatctatttgatttttgctaacagctttattgagatataatttatataccatagaatccacttgtcttaaaggtaaaatttaatgacttttaataaatttacagagggtgcagccaagtccacactcagctttagggcctttccatcatcccagaaaggttcctcgtgcccttttgcaattactgtctcttcttaaccttagcccaagtaactactaatatattttctgtctctatagactggaaaagccatacattttttccttttatttttagttgtgacccttaataattgtgcatatttataggatacagagtgatatttttgatgcaagtgtacagtatgcagtgataaatcagggtaatttgcatatctatcacctcagacatttatcatttctttgtgctgtgaacattcaaactctcttctagatacttgaaaataaacaataaataattattaactaaggtcaccctatactactataggacactgaacttattcctcctatctactgtcattttgtatatgttaatcaacctctccctatcctcctctccctgctactctcacaagcctctaataaccacaattctactctctacttttatatgctcaacttttttagctcccccatatgagtgagaacatgtggtatttatctttctgtgcctgatgtatttcacttaacataatgtcctccaggctcatattgccccatgtgacaggattttattctgttttatgtctgaatggtattccattgtgtatcacattttgtttatccgttcatctattgatgaacactttggttgcttctctattttggctattgtgaatagtgctgaaataaacatgggggtgcagatattcagtatactgattttctttcctttgcataagtaacacaatagcaggattgctggatcatatggtaattctatttttagtgggtttttttttctctttttttagtagctatgtcacccgggctggagtacattgatacaaccataactcactgtagtctcaaactcctggattcaagtgatcctcccaccttagcttcccaaatagctagcactacaggcacgcactaccacacctggctaatttttaatatttgtagagatgaggtctcgttacgtttctcagtctggtcttgaacacctggtcttgagtgatcctctctgtttggtccctcaaaatgctgggattacagacataagccactgcacctggcctatttttagttttttaaggaatctccatactgctttccataatggctctactaatttacattcccactaacaatatatgagttcccttttctctgcatccttgccagcatttgttaatttttgtctttttgatagtagctgttctaatgggataagatgatatctaattgtggttttgatttgcatttccctgataattagtgacattgagcattttttcatttatttgctggccttttgtatatcttttttgagaaatttctcttcagatactttgtccattttttaatgagtttatttaattttttttattttttgctgttgagttccttgtatattttggatattagttccttatttgataaatagtttgcaaatatcttatcccattctacagcttctctctactctgttgattgttttctttattgtacaaaagctttttagtctaatatagtttttcagtaccatttatggaagagaatgttctttcctcaatgtatgttcttggtgcttttgttgaaaatcagttgaagtaaatacatggatttatttctgggttttgtattctatttcattggcctatgtgtctgtttttatactaatgccatgctgtctgggttactatagctttgaagtcaggtcgtgtgatacctccagttttgtcctttttgctcaatgttgctttggctattcagggtatttcatggttttctacaaattttaggatttttttttctatttttgtgaagaatgtcattggtattttgacaagaattgcattgaatctgtagattgaaaaagccacacattcctaagcagcatgataataattcatgagtgcttttatactggaacttccaggataaaggtcttgaaactgtctataccagaaggaccttatttttttaatgaagcaaaggttatagggcttacatacatcttcttgcatcttttttgtctgtggtctcactccaatttttaatgtctagagcattaaataaattcccattttactgacaagaaaaaatgagggaaatatgaggaagaagaaaagaccgaaactggcagaaaagcaatggtaattgtggagttcaagccaggagatccctgttgttcatcactgctcactgctgagtctcgctttgctgaatatcaccgtacctccacaaaacataacgagatggaagaatacatacagattatccagcagctgatatttctgtgggttatcagctggggtggtgattgcttgaacagattccccactatggcatttgagagtgaaatcaaagaacagcagtggcaggtgtttggaaactgcatttggaattggcctcctacagaaagaagctagatactgacttcgtgggtgatgagagaagtcgacagcattctcagagggaagttgcttctatggcagctttccaagcacacagatttaggtttctttcacattaaatccctgaagatatatatagggcttgaggagcggggagcaacagggatgccaccttcatatgttgagtatctcctcttttggagataaaactgtcgatgctaacccgaaggagagtatttaggattcatcaactctgagtgcaatgaaagtataaaaaagcaccagttcatccaacatgctgtgcacccacagttcccatttttctatttccaaaaagattggtttctgagtcattcccaagtgacactgctccacttttcacctggctcaccaaagctctgcttggcctttcaagatagagtcgagtcatcactacccacattttcactcattggttagtttctcccacattttattctcggccttgagaagcaaagaaaccaacaaaaaaaccaatgtcattggtgtttgctgtaaatatacatagatttcctctgattacaaagtcactgaaaatcacataaaggcaaagtggcagagcaggtgacttttgattcaaacaatgtagtttgacatctatttgatacagctttctgtgaatccttggcagtgtacatgctcagtagagatccttgaatgaattagtgaggagcacagatgaactccattgtctgtaataaacgcttgactcattcctgacccctgcccccaccttgtatgcacacacgtttatatacacgtttgctggagttctgaaggtattgctcttagaggccaatatgcattttcacctcagttcaaggtgaaggggctgctctctaaggatcttaactattttatttcctcacatatggcaactttgtggagagactttgagttcagcgaattaggtagaaatcttattttattccaaccgatgaatttttttgagttaaacatctccactcaccatatcttaccacatctcacacattggttatgaaatccatcttagagattatgactaaatgaactgttgctcttcaggaggaataatttgtctctattatattgatagcagccttaacacctaccagttataaaattctgggcgtgttatttaattttttttcagcaccaaatgtctcatatgcaaataacatggaatgattctaagaaataggtggtattgtggggattaaaaattgcattccaggttcatacttcgctaaaataaataacagcttctgggaatggagaacttttgtttgtattggctcaatttctatttccagttttcccatagagtagctcatttttttctctggaggagtcattatgatctggttggtgcttatcctacccaatgctctgtagatcaagtatggctggccaatcaagtgttttgtgacccctggtagtccagtgagactcagacctggaaccttggtacatatattggtaaaaagaaactgtctttttgctggacttaaaactggccgagtgcaaacctggtgcttcagagaaccacttcacacatgaaaatttcttgagagtgaaaataaagcagaaaagagtagaactgagatatgggaaagagaaagatgaaatcttcctcacaaaggttgagtatctacgtggccaactctgaaatgagcaccattctagacttttccaccaagaggtgctctaaatattccttatttgtttaagctgatttgagttagcttttggcatctgcaactggaagtcgcaattaacttgtttctcattaatgtaattattgagagtaaaactaccacaacactacccacctgggtcactctaccttgttatacaaagttgatgctcaataaaggcagaacaccaaaagcctcatattcaagtaggacagaaccaaggaaaagggccactcataataaaggtggacattctgagccatttcattattcatacctctagtttcccaaggcatgctaggtaatattctaagctttttgttaaactcaaaaattattttggttatagctggatttcaatgattcatactttaaaaaatatatttccacaagccagtgcattcaaaatgaacttatgaattactatcattagtgagattaagaaatggcattctcatataggccaaaatacttggctaaagccacttaaactcattccctttcattattttataatgtactttgtgacagttattctaacaagatgcactgaaaggaggtactaatgaactgaacctattcaggagacagacgttcgctaaccaactgcatgatgggaaaaaaatgaaaggttgaggttgttgaaaaactctgttaacccgaatattccaattgcagtctttcatattcagagtgtgttaatatttttcatgggaaaatgtatttcttaaagtgggctttaattattcttgaaactaaatatccatttgaatgtccctgcctggtcatataaaaacagcttcatggaaggaagtcatcactgaaactgcttcctccaatttcctggccgagttatgttggctggagtagcaccttctcatgagatcataatcatggaatcctttgtggagaattattgacagcacatcaataagagctcataaaacatgtgctggaattaatggggcttcaacaaagatctcagacatgaattagctgttctaatgaaaattagattatgtttgctaaacactaagacattgaataatatctcaacatatgtaatgttacaacacaagatatacaagatacatcattgtcttaatctgttcaggctgctataaccaaataccataaactgggtgacttataaacaacagaaatgtatttctcaaggttctggagactggcaagtccatggtcaaagctctggcagattcagtgtctggtgaaggcctgccttctggttcacagatggtgtcttctcaatgtgatctcagtggtggaaggaacaaggcaactctctggggccttttccgtaaaggcactagtcacatttgtgagggcagagctctcatcacctaatcacctccccaaggtttcaccttctagtataatcaccttggaagttaggatttcaacatatgaatttggagggggtagggagggcttgggaggacacaaacattcagaccatagcaataacattcactgctgatgctcaagtagatagttgactcagttggtttttaatgctacgcacacatcaggtacaaatggataacaaggcatgtatgtatgaattcatgttttcatgaatttaactcctggcatcctgagggggtgacacaacttggaggcagattatctcaaagtaaccaatgtataatagggttctgaatttttttacctatacactttttgccttaaaattttattggtttttgttcaattacaaatatattccttattgttaaaaagtcaaagtgtattcaaagatgttgagttggtcagagcccaatcagaaatgaaaaatcacatagtaattgggatagaaagttgcatataaagattatgaactgtaataggagattagagtatcaagagattgactgactgacaagaattaaagagaactttacaaaatatcataatagcagatataaaaaggcatcactgaaactgaggggttaatttgatcagatgtgtctgccctccttgcttttggtcatttgctttttgttatttttttttttttcctttttccatgaaggcgaaggccagggtagctgaagtcctcaccactaaatactgaaacctaacgttcactggtcactttatggataacattcataggccaccatggtaatgttcgcttcagttgctttttcaggaacttgggtcagcttctgtctagttcacacccgttgagacacagcccttcaactgggcctgtacaagtgtccaagaggtggtcttttgacatcagagggctggtaacaccactaccattagggctgaggtaggggaccccaggaagaaccttcctccctcaggctgagacctggaccttgtgggatttctcagaccttcttaattttaccagttaattttccttattggttacatgaactgaataaagaaattcaggattttctctgaagaatcggcaatgtgatgccagatgtaagatctggaagaagcagtttacaggtttccttcagctaaattgtgcaaaaacgaaactttaattttccatgcatagtacattatatgacctatatagtcagctaattttgaaaattttatttcctgatgatgacaacttggtagggtattaaatgggactgtttaatcaaaagctggcacaaagtggctaaatacaaaaagaaagggtggaattgttttgttaatcctttcctttgccaaattgatggctgatgattaaaagttttgtaatatcttaacagaaacatggacatttcagataatcataatatttaaacacttttttgcctagttctcttctctccatagcctcaatcaatgcataattatataagagaacatttacaccgaatgaaaatgtcaccttattaatgagtatttaaacccatagtttaaggttagtttgctttagatcaatatttaggtttgaaacttgtagaaactaatgatctatggaattctttgggggtgaaggctttaaaacatatcccacttttttgatttatggatttacttgggctaatttctaaacaggcattcccagatggaaatacttcagtgaaatatcactttttgaatattaaatttttactggagagtaattttgagaagcaaagatttgaatcatggtagagatgtgtgtatttatactttttggacaaaaattaacttttatgtatacctcaaatagtaaggaatcttcttagttttctctgtcttccttttacctcccttttcatttgtcaagaatttagtattaatatatgtattatggaagaaagtaagaactaacaattatgactgcattgacttgagttcatgttacaaagtttatcaataagttattagaactcaggagcgctgaatttaaattcagaaacttatttacaattaatgtgcctgagtttctatttatcaattcattctgttgaacttccactttatggtaaaacagatacaattctttcttcctgaatatttggtaagaggatttttttttcccaatatttcaccctttatccaggacaggcacctgaaattctgtgtgaactacacccctagcctgacccagccccaaacaaaaacagtcaccatgatgatgatattactagcatttgaagaagggtctatgcttattggatagctctcaagtcacacatagatgattttaagtagtgcttagtttaacttctaatctcttgaaggcttagttgccaaaacaattagcaggtttagtcagggagaaggaagcagtccatctgcttcttttgtgccactgagagcaaacagccaactgatcgactgaatccctcagacaattagtcagaaccatttgcagcccccatgtccctgtaacaaccttgttgacacatttatagatgagaagacagatggttttgctggaagtgaatttgccttttaaatatataatagcaccttataaataaatggtgtttatacataatagtgtaaaaggctttcttatacattctgaaatctgatgttcacaggagctcttttgtaaaataggtggttttacacataaggcaatagagtattacagaggtaaagtgattacccaagtttatatatgagctgggattagaaccaccagtcttttgactgccaatccagtgttttctctactacacttttagaaatgatgaagagaatgggatgctcttagatattttatggcaaatgatctaagaatactcatatcttcttcccaactataccactccacttcatggtgtccccttaggagaccagtgaacaaggaaagctgtttaagaaagcacagtaacattgcatgtgtaactaagaatgtacaaaatagcaggtcagaactcttgtaaactgggggcaaagaatgtcatctagccaaatgcaagactcttccatctctcttgaacacaaagggaaatctcaagctgttgtcattggtcaactccataggagcacaaacgagggcagagaagagagcagcagaagatgtatgatttagaacatagcataacccttccttttttaaaatcactccagctgcatagagagaaggagcaccatgctcacccttgcatcgggtttatatgacctttgactatacagtgaccctgcccactagtaaacaggaaccattctgtgacatagacctagtatgtcctagcgtctgaactgttaagtgtatatcactctcctttggaaagacacagagtggacagggaggaaggacagaggaatcttgcttccttcccctccttcagaggtcagcatgcactctgaagcgctgtaatttttacaaagtcttttcaaaagaactcatgtatattcctttactgatttgtactgtcagggaataagcagacatacctccttttatcagtctaggctttgctgtacagagacagagagcaacttaaccatggacacagaatggcaagtagcattaagtaattctgttttgaccacacttatttctgccaaagaaagctttgagatgataaaatcagctctagtgtggatattttgatatttttatttgattgagattggggaaaaacaccactatagatataaatcgtcacagcatattttgggcttacctatttaaactaaagaatgaattttttatgtcttcacagtggttaggtcagttatctgcggttataagaaaaaaattagggttgcaaaatagtacttatatttttcataaaattgcaaataagaataattatttcatactaaaagttttggtacttgacctattggaaggagtataaaatgaataaagtctgtctctattgcagatttaaatagaaggaaaagaatgcagcatttgcttggtgatgttctgtaatacttttccagataccctgagattagcccaattaccttctggggatgtttttggactaacaatactatttccacaggagactcaacatataatggaagaaactgttgagaagtccaactcttcaagactttttaaaaattgtgttttcagcttacaaatgaatcagcgcaaagagaaatagtactttagagtgaaaaacagaacacaaatcctgaactccagctaagtgtgcttttcctaggctgtatgaagtcacttcccatggtgccttgggagcaacattgttgccttttaatttcctctgaattggatcatcagttttccttatgactttcttaagacaaatgacccagcttttcctcctcttttccaggcaatggatagatggctatgaatgggcagaggaaaggatgtgtggcaggcacactagcatcccatttaatgcttcattcaaaggttttatttttcatccgccatggatgaaaacccaaaaagtccatttcactttggagccaaagccaaaagcaggactaacagaaagcgcagggtgtgagaaagacataaaatctgtaattggaaaatcttgaagttttgcaaattatctgaatagtgccacataaaaatttaattccagagatttcgttttgcccttctgtcatgttaattttgttttgtaaactattagctctcagctttggcctgaccaacaccttgccctgcctaagtctgcagtaatacagcctaaaatcaggttagtatactagcaagatgcatatactttacacagcttcagatgggagctggtaagagctttttgttgaaatgaatgagcttaggagatcctctgcaaaggtttagtcccttctcctgccctgcttgtggcattatcctaagtccatctgtgactctgtgtttaggtaagaacgtttctaatgaacccttccagtctattacatacaccagaactaataaagtactcactgatccttttaaaagtttgctctgtttaaataaatattcgtagacttttctttgcacagtctaaacaatccttcttttcttaaatattaaaaatgtgacatatgaagcaaccatgccaactggttacaagttctaaattagcagtgtctaaattaatgaggttttactgtatattaaagtataatacatctctagcacctgtgcctgatgaatttttgttcctagcaattagatgttatttaattatagttagagtctctcacatcacctagtttaattgccacattaaaaactattttgagagttgatttgcctaacatcacaaatttagtttgggaactgaaaatgccatttatttgtcctacttaagtgttattggtaagaattaagtgcaggcatatattgttatataaactgtcattttgatgtagactacatagcatatctgtgtgtgtgttgtatgtaacacttagcatatggtgactcttaagtaatgatgtgagacgtgtgtgtgtgtgtgcattggaaaaagtgtgatgaaataaactacatttttttatctcctatttcctaagaagcattttaagttgatatttatcctcttgaacagagagcagaaaaaagatcaacttatccctgatggattatatgattgtatgattattagtcttccctggattttggctaaaaactagatttgggggtggtgattggcactggatcatatatcttaatcataccagtgagctttatctttctttaatgattttttttttcgagacaaggtcttgttctgtcacctaggctgtaataatctctttaactttttatttttaaataattataaattcataggaaattacaaagaaatgtaccaggctgtctcatgtactctttgcacagcctcctccagtgttaattaacatcatgcataataccagtataatatcaaggaataccaggaaactgacattggtaaaatctacagagcttttacagtttttaccagttatacctgtactcatttgcatgtgtgtgtgtgtagatctatgctcacatgggtaccttcattaaccatcctccagaattacgatatttaatgtaacattgccacagggcttccttaagctaccccttcatagccatacctacacctcctcaccctctgccctgcccatcacaactactaatctcttctgactctatatctcaactactatataaatgaaatcatatcgtatatacccttttgagattggcttttttcatgcagcgtaatttccttgaggttcatccaagttgtgtgtgtcaatagttcatttctttttatggctgagtaatatttcagagttatggatggaccacagtttgattagccattcacccattgaaggacatttgagtagtttcctgttattgaccattataaataaagagaccatggacattctgaggaaagtaaattttaacttcactgagagaaataccacagtgtgcgatttctgggtggtatggtaagtccatttttaattactaaaggaactgccaaactattttctagagtgactataccatattacagttctagcagttatgtatgagcaatacagcttttctgcatcctcaccagcatttggtgtgatcactctttttcagtttggtcattcagatatatgtgtagtgaagtctcattgtggttttaatttgcattttcctaatgtctactgaggttgaacatcttttcgtatgcttggttgccatagaaatatccttttcagtgaaatgtccatgtcttttacctattttataattaggttggattttgaaagatctttattctaggtgcaagtccgttgtcacatatgtgatttgcaaatatcttcttccaaactctaatttcccttttcatccccttcatggggtcttttgcagatcaaaagtttctaattttgatgaggtccaacttatcaatttttccattaattggttgttgttttgatgtctaaggactctttgccaagtcctaggtttagaagatctcctattttttttctagagattttagtgttttatcttttagatttatgaccatgatccattttagttaattttcctataaggtgtgagatttatgtttatgcttatttcttttgcttgtggatacccaattgctccagcaccatttgttaaaaagattatgtctcccctattgaatcaaagaatgattattttattttattttttgtagagacagagtcttgctattttgcccaggctggtctcaaactcctggcctcaagaaatccacccaccttggtctcctaaagcgttggtattatagatgtgagccactctccctagccagcatgatttatttaaaggtacatagtccttaaataaactacatgtcctgcataaaaataattagaagtatttgagcacccaccctgtgccaggcatatttctaagcacattccctgcattattaactgattattatttgcagaaaaaaatgcgtgcagggtattgttattatcaacattttagaaatatggaagccaggttttggaaaaattaagtgatttgcccaaagtcataaagacagtgtgacacaaagtagaatccatgtctgtctaacttgaaagcctataatatgcttagtaataaaatgttttcttaccaaaggaagctcagaattaaggcttttcatctatcaagcctttattttgttgtatagtcaggaccgatgacctctttagaagacccttaaaaatacgttttttctatctcaagaactcagctggaggtttggagactggttacgaaatttgaccaggcatttgacatattatctatgtccactttaaaaaataaaatggtagtcttcatcctgaatcagtttttgacaatacactttgtcgtgccagtagttacggcctgagcatctagcacagttttgctcccttttacttggtttgtatttaacagaacttcttccaaagctgtgttgatttttagcagaggccatgtagctaaggatgactttctttatttattgagtctctaattcttttttaaaatcttgataagctattttcccagatattaacctgtagtaatgttttctttgtgatttacatgttacaccctcaatttacatatatttctactgttctacttttcatttcatggaggcttgcatagatatggatactaagacaaagtgaacaagagggtcacctgataccatatgttccttggaaggggattgatagcagagttttaccgtagttccattttctttcataaacatttgatactttggtcacctttagcaaatagaaaatgtcatggatagagcaaaaatcagaagatgaattgccttgcttcctctactgattacttgctaaatgaccttgagcagcttctaattctaaacctgcccatcctgcaagtacagatcacaaaggaaatcaatgttttgctcttgaggattagcttttattgtcttcgtgttttgcgaaatgtataagctggtcttttggaagcaagaggaaatatgttggtcttttacaagagtcataaaagagggctcatctaggacagccagggtaataaagcgggtatggtataagacacaggcataggtaataaagtgactcaaaacagtctccaataatgcaagctccctgaggacagggatctgtgtgttttgttccctgctctatcttcagagtcaacgacgatgtccggtaccatcctctgtctgctatttccatgcctgtttccacatctccatgtggagcttgcaaggtaatgaaatgaaccttggaactgttggcatccgttgccttcattgtgtccaaacaaacctcccaggggtcccaaccatcctggggaaacacacctgaaccaagaataaagaatctctaataatcttgttcaatctgctttcagtcctttggtctcaatattttttctataaattgagaaggtggccgggcgcggtggttcacgcctgtattcccagcactttgggaggccgaggcgggtggatcacaaagtcaggagatggagaccatcctggctaacacggtgaaaccccgtctctactaaaaatacaaaaaattagccgggcgtggtggcgggcgcctgtagtcccagctactcggaaggctgaggcaggagaatggcgtgaacccgggaggcggagcttgcagtgagccgagatggtgccaccgcactccagcctgggcgacagagcgggactccgtctcaaaaaaaaaaaaaaaaaaaaaaaaaaaaaaaaaaaattgagaaggtaactacggacttcattggtctattgttaatacataatgagacgatacagtgaaagaactctccaaatgacaaagcactatctccatctaagaatatcgcttctgttgcatcatagtgaagtagttccacaggtgtttctgctcggactgactggttcaaatctcggctgtactgccaggatttaagacactttgaaaatgggcaaagcctcatttttcctaggtcaaaaggagttcaagattggggaaatctgaggattcagaaggatgataaatgttagaacatggaatcagggtgcttagattcttggtgcctcaatttctctgtcagttaaatgccgtatgatcaaatgactcttttctcattggcttgatgtgagaaagaaatgactacatataataatcagcaacattcctggcacatagtaaacatcgatgtattattattaatacctccacctacgctatatactgactctctatcctccctctcttcctccttccctggatcttaaaagatgagtgtgattagaaacaaaattttgttgtgataaagtccacctgaatgttccctcagatactaactaaatctctttcacatgcaacctttggacaaaagtctcttcctttttgctaggaattttcctatttttctcatttcttctcctcctgctttaggaaagaaaaaaaaagcatatgcaagaattattttttcttctccccagatgtcaccagcactaacacctgtcctagttccagctctggtgaactccagcagacctgctcaagtggacagcattagggaccttgtcagttttgcagtgctttttgcctgaagccacctcaggtccctcatgctgcaggtatgctgaggggcctggaggtgacaggctgttttgcacccaggcacactgaggcccgggtgctgcagggctgtaagggtggccgtactttactctctcccaactcccccacccgtgtcatttttatttgtactttataaatccttttcacttttgcaagttccttttggccgcaatctgaatgcagtcctgtatgggataaaggaatatcataagtatatattttttaaaacagcaacacgattcatgactctgttgcagaatgtgaaggagcaagtctctcaattggctaattgaatcaagctctggtgagtatgttgagctctgagctctcctgaagttgggctctgagcctgaatcaattggtctgatctccctttctctttatttgtatagaaatgagtaggaattctgtctgtgttaataatgtagggtaattttggaaaggtaacttaaatttccaggctatggtttatgttcataaagtaaagataatttgaatattgaaccactgttggctaaaaggcagaattaggtgtgacctcacttagagtacttagttgcagactgttgggggaaaattctcatattaaggtttagactttgagaatagggtgattgtgagccttctgtacataactgactttcaatacatgctcattaaaaccaaaaaagctaaatgattcaaacactaaaaatattcatcgtgttaatttctcataacctttatgcagtggcaatattgcataaatatttgtttgtaaagtgtaaggtcagggcttattttataatgcaagaaatccccagtttggttaatacaaaaccttaacaagaaccagtaagtagaaacacttgataaagctatataattgtagatcattagtggggaaaagacttcaatttgccttaggcttgatgtttctagaaataaaattattgagaaaagattaaggatgagataaaccatttggaggaaaagaagatcataaagtgatagaaaccagatcttaaagtaaacatgttattacagttgacctgattggttggaagacaatgtacggtaaatgcacctgacaacaataacttaagcataccctgagaatgactctgtatggcagatgcacctgaatgtgtgttcagagctggggaatctgggaatggcaaacctggagatgggctccttatctatgataaacatctgagtcctgagttttgcggggtgggtggtgggcggggggcggggggcgggggctgggggtggggtagggagggtagatgaagtttgccaggtgcaggtcattaggggagggtgttaagtaaaaatgctgtataaactgcatgatgtttgcaggcagttgtagttttcctgtccagcccacagccactggactgtaggaaggcgaatatgttgtccagcccattgccatgggaccatttctgtaattaagggtgttctcctgtccagccctctgccacagaactctcttcacggtatgaaagcccctaataaaaccacagatcttatttgctggctctgggtctcttcttcagcctcttgaacctggtgccttccctactgaaggtaataggggctcagcacaacagatcacccacacacaggccacctgccttcagaaacccaattcaaatggtcataagcaccaaaagaaacagatttgctcaggtgactaaaataatccagggaataatcagatggaggaatgtggatgttatccccaggacttgatctcccctagtccctgactctgcctttcccatgttgccctcactaccgggcagaccctttctaccatgtcaagatcactttgggaattccaggcttcaactccactagctcagcaattctacttgggagaaaatgtcttccccagctgttttagtcacagctctgacaactcagtctcagtacctggtttgagtcataaggcgtcactgacaaaatcacaactgtcagggcttgagatgtgtcatttgtcctatgtatcaaacagcataagaagagtggtgtttccccagaggaaattgagattctgttatcagtaaaaggggaatggctgctcaggaggcaaaaaaaacttgggtaccctccaccaccaatctaccaaatctggatttgaaaggcataggacagcagacagtcaggactaagagcaagtcgcaccaagaaagaagaagaaaactgaaagggaaaatcagaaagccctcctgaggtccatttcacccactcagtcataaaagagcagaattaaattaaggctgctaaaagtagagaaggcacaccattgacccaatatgaagccctgacaaggagatttgttgggtttttttgtgagtaccctcctgagccagaggtggagtgtctcctcttgggtagacaactttagtgtgattcatgtgtttgaatcacacagcctccgaaggccacgtgtctagaatagcaccaaacaatgaaaaatggctctagaaacatttattgttccttcagctttttctatctcccaaacgtatattgagactaatttattaatgttaagtcatacgataaattcattctgggaggaaaagcatttccagggagtaactatacgctctcatcacttatagctttgtccccgcctcatcatccagggtgatgattttaatccagacttctccatgtactaactgtggaaccctgggcaaaactggctctctatttgcttatctttccaaaggggactataatagtataccctgcagaggtacacatggctgttattactgtttacgcatttgggcttcatttggagacagtctcagaactgatcttatagcgtaagattatagaatgagcttatcatataagacatacttgctcatagtattccaagaaagtgcaacacaccaatgcttaatattaggagtttagaaactaaactaggaatcagattactcctggctcagcctgggcccttgaactaacctccactgcatattttgtcctcacagcgtccccacagcagctatccaggcttcctaggaataacacacaatactccctattctcaagagagtagctctttccccaaaatcttgatgtactcagtcagctaagaggtaccttgcatgctttaaaattcccacctattacttatttttttaggtgaccagtctctaaggcagaacaaaaattacttgagcggggatttagacagggattccaagaaaaaaaaaattagctaaattgggcaagcctaaatgatcttttagtcatttgttgttttttttttttagcaatttccttcttccctggagcctgatcctgcaggacaaggatctattttcaagtcaattacaattcctaagggatataattacctacaaaatcagcaaaggaaccctatttctcttatggtaatgtaatagtaatttttaaaataactacaatacatatgatagaaatggcatttgctttctttcaacttttcattgcttttagtttcatgccataccattcccaaatctccaacttaccagcaagcagtgataaatggcagcctgtagattattgttaatcaagaaaaaaaaaccaaaataaattattagtctattatacaccattgtggctattctatttctcatttggtaacattcagaagtctcctcaagaactcggacaacagacccttgagagtgtgagtggtgacaatggatacagactgagctgcccagaagcctgttcatagtctcagactccaaattctagggctcaactccagttccctgcccacagtgtggcatttcctatcctttttagctacttaaaaaaaagtttgctatggctatatgctaagtactaagacacatattctcattttatctacatgccacttctctgttaggagttacaatattcccttcttttgtcattttcatttcattcattcattgcatgcccactctagaccaggcaacagcctaggtgctatggatatagcaatgaagaaaacaaagatttgcatttcagtggaggagaaagacaatatgtggaaggagaaagtgaaggagaaagaagaggggaaggaggaggagacatcagggagatgacatttaagcagagacctaaaagaagggatgttgtgagctcagggggaaagtgtttcaggtggaagaaccatcatgtgcaaaggtcctgaggcagaaacagtgcttgtgaagaacacagcatggcctctgtgagtgaaatgtgctgagaggggttggaggaatatgagctgatagatagtgccaaagccttggagggcaggaaaaaacactgggtttctttcttttgatcagccatatgtaggtgccaggaaaggagtgatgtgatttacctgtgaggaaactgaatctaaaggaatgttaactaactcatccatgtcacatatgtgggaagccccatcatcgggactcacactggggtctatgcagttcccaaggctcagtcatttataatcacagcccagcttctcagtcactcaacagataattccatgtatatgtgctctgtcattgcctttataaagacaatgagatctctttgagatctcttcactcataatctcagttggcttgtttctcatcttcttccttgatcctaaatgtcagcaaatctccctctccagtcacaggtccaattaattatctcttatgaaattcaccagatgtaacccttcttttccattgctcctgctactattcaggtttcaagttttgtctcaagtcttgtctgctctcacttcccaggattcctgaaccctcaatgatccaatactagcctacatgttcaatttcatttctcctcattctctcatgtctcaaactggtcaccttcagactatattttgactatatgctattcttaaaaaaattacatcaaattatattactgatatctctttaaaaaattgaatctgacagtactgggcccatggtcccacaaagctgaagctgggtagtggctgcccattttggatggggcaagagctctccagttctccacagtctccaccactctgtaaaatcagacatcgtcaggcatctctcttatcattggaggcatctgtcttatcattgcaggcactgacacagttaagaatagtggctataagtactttctgaagccaaactgcctgggtaccaattctggctctaccacttactaaacttatgttattgcccagctacttaaaatctctgtagctgccctgtaaaatttaggtgatatggtttggcagtgtccccacccaaatctcactttgaattgtagctcccataattcctctgtgttgtggaagggacccagttgcaggtaattgaatcatgggggtaagtctttcccgtgctgttctcatgatagtgaataagtctcatgagctctgatggttttataaaggcgaagatcccctgcacaaactctcttgccaggtgtcatgcaagatgtgtctttgttcttccttcaccttccaccatgattgtgaggcctccccagccatgtggaactgtgagtccattaaacctctttctttatgaattacccactcttgggtatgtctttattagcagtgtgagaaccgactaatacagtaggtaattatgataactacctcatatttctggtgtgatggttaaatgcactaatacttataaaagcatttagaaaaaatagctggacatagcactcgataaaggttaccttttgaggttgctgtttataattcccactgtataccaggtaagttggtatacttgtcaaaatgaacatgctttttacaatcccatctccttgcccttgcgtactttaatcttgcttcccagatggttttcccaaatggtccagtcttctatgatcacagaatcttatccatctcttaagtaaggcctacttcaaatctcacccatttgtgaaaccatcactggccactctgtatagatattgtttctcacttctttctatttctgcagctcagattttgtgcactacttactgcatactcatctaaccctttgcattgctgtttaactgtcttacattaatattttctctctccagccagactgaagaaccctaatggtgatgcatggcaggtgatgattgggttatgtttcaactttctggcaggtagttggcagcaatgctagatagtacaatgattattttctgaattctcatggggaggattttatcatgacatttttcttggtcaatgatactaaattagaaggttagatgtttgtctaatgagtgcaatattgaaacaggtagtatgttttaaataacaaggttctggagttgaaacaggttttgtgccccttctaatacaggttaatgcagaatgaaggtcattattgtgtgacattagtttcagattgaaggtcattatcatgtggcaactgggttttgattcagtgctttcctactttacagaagctgcaaacataattggcaaatctgtaaaaatgactacagcattagtttctttgggtttctgaaagttatgcatggaactctgtgtttctgtctatctgtctgtctgtctgtctgcctgtctatctatctacctgtctatgtatgtatgtatgtatgtatgtatgtatctatctatctatctatctatctgtctatctatctatctatctatctatctaatctgtctatccattgagaaatgagtatacttcctactgggcattggtcttcaacatggataaaacacagaacatgagaattcaatattagaatatgggacaaagacagtgaaataattactgagaaaaatatgaaaatcaatttcatcaaaattgaaccacctaagacgattgttagtggaagtatagtaattagatgtgctttttcattaatgtcagctaatacctacctaaaatttagtgtaatttcagaagacttttttaaacctggaagaaagatacttgtaacatcatttgcattaatctctgaaatgaaacacttccatatggctttcatggtggggaggggactataattactgaggtcactttctaaataatactactggaatctattcatatgggaaccaaagacatgctgtgatgccaagttatttcctctgtggaaataaagataaaggtaaggtaaaggaagggtaaagatatataggaatattacagatgatcccaggatttaacagtagacctaccacaattaagtcccagttctctgaaagtgaccttctaggatgttcatgtctgactttactgtactaagggccattgtattatataggcagaagagagtaatgagattgtttgattggttagagaatgctaaattaatcctgccagcagtaagccaaacccacagtgccagcctacacagtacaataaatagaaaaggtaatttgacactctgcccaaaaaactagctttggaagtagcagccacttggcctcattgaaaagtagggagaaaatgaattttgtaatgaattacttgtcactcaaaagatatttggtttacaacaggaaataaaaatcattctgaagagtggccattttgcctaaaaggaagcaatacatcaaataagggctagtgaaacagatgaagagtattcattcatctttaggtcatctgctgacacaaacaattagattaaagtggaatgattcaatctgagaaatgtgaatggatagagaaggaataaagaatattctttagttctcaaataactttttattaaatattattgtttctcttttattaggtttggcttacaaacctatattttgtaaatcttatttgtgttcaatttagaaaaacataatccatttacatttattggttcggttctgattgcagtaatcattaaatctggataatgaaaaatattcaccaactcttcagtgtaccaaggaagtattgagaattgagaactttttttaaggtcttagtgtacaatcagtaatcaccactatttttccttcgatgtgacatttattgtgaagggacctatatatcccactttatttctgggatttggagctaaatgttgtctctatgtccgttcaggtgatgccagggtcaatggccacagcatagaggatcactaatagaaaaccaaagcccattcttgagagttttatagggttttttttaatttatttgtttgcctgtttgttttatgaaggataatgatttattttttaagggaccctaggcttcttaggattttctgtcttctgaagatattgactaaagtgtccaaagtggggatggttggagatgggctaataggaagtggaaaactagtccatttctctggctaacaggcagttaagtctgtaatacactgatatttcagtgttaacaaacacttttaattaacagaagagaggctaatgaatcaatttactgataatttgtgaatgaattaatttgttaatcaatctatttactaataattgtttcctttcagaatactaactctgctagagtatttatctttgataaatagatactatttatcaaagccagaaaagcgcattgaaatactttccaaatattagattctaacatcagatcagatggctactccaagcacctttagactgaggcattataacattccttttaggtgtgagtagaataaaggaatttttattcccacttgatattggatgactctggagggaggtcctagtgcctacttactgaggagtttccacagttgtaaatacacttcctcacctcaaaaagtcttcctttagccacaggggaaatgctgctttttcaatacgaggagttctctcaaaccagaacttccttagctctgaggtgtgtcacagtggtcagagcaggtagactggctgggagaccaagaccttgattaggctacctaacatgtttgtgccttggttaccacatctgtaaagtggggataataatagtacctatctccacatattgtagtacaaagtcacatttttaacagtgcttgatccaggatgttactctcaggtgcccaccctaagagagaaaggtgtcattgaaagaattccgtctgtaaaattattttggggtttcttaaattcacatagtcttgtacatagtttaatgtacatggccttggcattgtgtaaaatgttatttggacactctggaagaagaggatagcaaatttgattctagggttataagactggagggttaattataatataaatcagtcaggtaattgggagaagattggaggaaatttgatacatgtttatgtgtttatcaagtgattgcatctgcttttcactctctgctgccaccatctggccccaaaacctttgtatgagccacaatagtcacatccctgggacatctttgtgccccctccagtctcttttccacacggcagccaatatcatttcttatgattctctactggttcatgtcattcctacacttggcatcactcattagttggactttggataaacagaaagcatcaagctcttgcctcctttccagcttcatctcatgtcttccctcactcgtaacgctctgcttatgccagccttctctctggcccttgactatatggagttctttccagcctcagggtatttgcaacctgctgttctgctacacaggacatctgccattcacactttctatctctcactcctgctcatcccttagatctcagctaaacataactttcttggatggcactcctttaaagcccagccacccgaccccagaatttaaattggcctctccccatccttaatctaatttccaacagggcatactgaccttttcctttgtataacttattataatttgtggtgtcatgttttctatatgcttgtttaacctctgtcttccccaatagacagttaactttataaagccatggacggtgtccatcttttttttttttttaagtgctgtactctgcctcagacaagatgtggttggtgcttaattaatagttgttgaatcaatgattacatcaacaaacgaacacttagtatgtgacaagcactgggctaagtgcataatactcatgattttatttaatcctcacaataaccttttgagttaattatcattaatgtcattcacaaatgaggaaataatacttcttcatgcagtgagcttagaagggactgttacatcctctaaaaagtggccaaccttcccctagagtatgggctagactcagtaacttgcttccaaggaatagagtatggaaactgaaatgatggtaaaaatagtaacctcacagtggataaacttggaagccattatcttaaccaagtgaccaagtttaacatatccaatgataagttatcatgtgccccctgatttcacctctgtgattttcttctctaaaattcataaccccagcctaactataaggaaacatcagaaaaattcaatttcatggacattccataaaatatctcttcgaaactctcaaggtcatgaaacagaaggaaagaaagatgtcatagattaggaggaggctaaggagatatgggtgctgaaggcaatgtgtgatcctggaacagaaaaggactaaagtgaaaaaactggtaaaatccaaataaagtttagttaatagtaatgtgtcaatgttaatttcttagttttgacaaatgtgctgtggttatataaggtgttcatattaggagaagttgggtaaaaggtatggaagggctctctgtagtatcttcgcaactttctgtaaatctaaaatatttcaaaacattttcctttaaatggctacattggtttggaaaccagggctgacctttagtcagcatacactcgtggttgatgtattcaagttgatgtaatatattggcttcaattggtcaggacttgagcatggcatgttgttgaccgtattgagaattactaactatgctccctttttacaaaattatgatcaactttctattcactcaaaagtattttttaataattcttttctcagaagaataagaaactgtgtgtgactttaagtcgttctatttaactgagtggttaccatggtgaatctaagtgttcagagaataatttcaaatcgaaactccagataatgcttatgccacagcaaaagaaagatcagctgtcaatggtgtggtttctcagagccacataacaaatataccaatttatgcctaatattggaaatcttctagtccaaccttactgggtacttgttggagtatcagaagaggttgaatatgtttttccaggttcactttcttccttgggatgtcacagaactgaactctatcagaaatatgctagggcatgttttattctcttctgcatcttctgtcagaaacagccaacaagtgccattttcaagtcgctacagatctcacctagacccttggaaatatcaggttctgctggattctgatcaagagtgcccacgcagtaacttagaatctgaccagcatgccaggactcacatctagctcttcccaaaggcacacgtgggcagggattctcaaatcatctggggatgtcgataaaccacagatgctgactcagtgagtgtggggtgaggactgacactcttaatttccaaaagctcccaggtgccactgtgggtctttgggactgcattttgaatggaaaggtgctagggtatttttaatgacatcctaacgaaattatgccattagggatttaactgtgtattccacagctttactttccttttcaatttaacctctttagttcaacaatgtaacacttgtggaactccacaaattaggatgcaaaatgaacaagaaaagggatttagttttaactgagatgtcccttcacaagacattgatagaaaaagtgaatttattcttttggcttaggagtgacttggcgatgcgggctcttttttggttccagatgaactttaaagtagttttttccaattatgtgaagaaagtcattggtagcttgatggggatggcattgaatctataaattaccttgggcagtatggccattttcacgatattgattattcctacccatgagcatggaatgttcttccatttctttgtatcctcttttatttcattgagcagtggtttgtagttctccttgaagaggtccttcacatcccttgtaagttggattcctaggtattttgttctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggtttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagtttccaaagggaatgcttccagtttttgcccattcaatatgatgttggctgtgggtttgtcatagatagctcttattattttgagatacgtcccatcaatatgtaatttattgagagtttttagcatgaagcgttgttgaattttgtcaaaggccttttctgcatctattgagataatcatgtggtttttgtctttggttctgtttatatgctggattacatttattgatttgtgtatgttgaaccaggcttgcatcccagggatgaagcccacttgatcatggtggatgagctttttgatgtgctgctgaatttggtttgccagtattttattgaggatttttgcatcaatgttcatcaaggatattggtctaaaattctcttttttggttgtgtctctgccaggctttggtatcaggatgatgctggcctcataaaatgagttagggaggattccctctttttctattgattggaatagtttcagaaggaaatcaaactatactacaaggctacagtaaccaaaacagcatggtactggtaccaaaacagagatatagaccaatggaacagaacagagccctcagaaataatgccgcatatctacaaccatctgatctttgacaaacctgacaaaaacaagaaatagggaaaggattccctatttaataaatgatgctgggaaaactggctagccatatgtagaaagctgaaattggatcccttccttacaccttatacgaaaatcaattcaagatggattaaagacttacatgttagacctaaaaccataaaaatcctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaacgtcagagtgaacaggcaacctacagaatgggagaaaatttttgcaacctactcatctgacaaagggctaatatccagaatctacaatgaactcaaacaaatttacaagaaaaaaaaaaccatcaaaaagtgggcgaaggatatgaacagacacttctcaaaagaagacatttatgcatccaaaagacacatgaaaaaatgctcatcatcactggccatcagagaaatccaaatcaaaaccacaatgagataccatctcacaccagttagaatggcaatcattaaaaagtcaggaaaaaacaggtgctggagaggatgtggagaattaggaacactttgacactgttggtgggactgtaaactagttcaacccttgtggaagtcagtgtggcgattcctcagggatctagaactagaaataccatttgacccagccatcccattactgggtatatacccaaaggattataaatcatgctgctataaagatacatgcacatgtatgtttattgcggcactattcacaatagcaaagtcttggaaccaacccaaatgtccaacaacaatagactggattaagaaaatgtggcacatatacaccatggaatactatgcagccataaaaaaatgatgagttcatgtcctttgtaggggcatagatgaaactggagaccatcattctcagcaaactatcacaaggacaaaaaaccaaacaccacatgttcttgctcataggtgggaattgaacaatgagaacacatggatacaggaaggggaacatcacacaccgggaactgttgtggggtggagggagtggggagggatagcattaggagatatacttaatgctaaatgacgagttaatgtgtgcagcacaccaacatggcacacgtatacatatgtaacaaacctgcaggttgtgcacatgtaccctaaaacttaaagtataataataataaaattacaaaaaaaagaaagtgaccccagtatgagataatttgaaataaaaaaaaaagaaaaagtgaatttatatcacctacctgctaaaagactgattttataaaatgatttatttatttaggtagaatcatttgtgatccatgttgagcaagttggagaaacgctctctgctcaatctccaagtgaactaagggctttgtcaacttgaccaaaataccgtccaatttagggactgtttccatttgctagataatcctctcagtttgtattcttgcttttttctcccattatgattcactaactagtgattacccaaaccctaagtcctgggtttaggattttttttttttaaattttcagcttttattttagatatggagggtatatatatatatatatatatatatatatatatatatatatatatatatatttcatgggtatattgaacccagccaggtagtgagcatagtatccaataggcagtttttcaacccatgcctccttcttccttccccctttagtagtccaccatatctattgttcctatgtttatatccatgtatgctcaatgtttagctcccacttataagtgagaacatgcattatttggtattctgttcctgggttaatttgcttggaataatggcctccagctccatcatgttgctgcaaaggtcatgatttcattcttttttacggctgtgtagtattccatggtatatatgtaccacattttctttatccaattcaccactgatgggcacctaggttgattccatatctttgctattgtgaatatagtggtgatgaatttatgagtgtgtgtgtctttttagcatagtgatctacattcctttgtgtatatacccagtaatggggttgttgggtcaaatagtagctgtgaacacttttgggactgtggttaggccagatgtcatggttcaaatgatgttagacattaaatgttgtacgcattttaaatcttcagatcttataaagttttaataatttctgtagttttattgaaaacattgacactgcttatttgagtcatggattgttatatccatctggaaggacagtcacccctgatagaacacagcattttctgttagtcagcataatacaggtttttagagtattactcatggggttggaagtttgattttattcagaaatatttttaagagatggtgtcttactatgatgcccaggctggactcaaactcttagtctcaattcagagattctaatatccctcacatagggttttgaaccctgaaaattggtaaaagtatacttctatggtataaaccaatatattatacggtggaatttcactgtgatttgctaatacctgacatacaatatgctgtttagtctcttgaatagagactagtctcatccttatattttgtcatttttttgtggaacatacacaaaaattcaaatttttcatgttcaaaatttgactataatccctcttaggtagaacagatactttaaccacacacacatacacacacacacacacacacacacacacacacacattttgtaaggggatactgaggcccagggacttactcatagtcatgaagttactggcatttgactctggaaggggtgatagagatttcatcctatgacctcgctttacagaacaagtaatgaagctgagagaggctgggccacttgctcaaagagttacagcaagtgagtggaggggcggggggcggtcaggactcaaagtcacctatcttgtctctcaatccaggataccatcccctgccattctctgtctcaggccagcacagcactgggcacccagcatccttagtctatggtctaggtctttttattacactataaacctatgtttcgtgtatccaagcacacaaggtgatttggggaataccatatttagacaaacattgattttgaaattattcatttactttaatgcatatcaatatctgtgtatcttctatttacaaatgagaatgatttgccaaataacagctatatagaattttatttttttaaatatactcatttcggtcaaaataaagtagatttgaggctgggcacagtggctcatgcctgcaatcccagcactttgggaagccgaggtgggcggatcacttgaggccaacatggtgaagccccatctctactaaaaacacaaaaaattagccgggcatggtggtaggcacctgtaatcccagcgattcgggaggctgaggcttgagaatcacttgaacccaggaggtgaagtttacagtgagccaagatcacaccaccgcactccagcctgggcaacaaagtgagattctgactcaaaaaataaataaataaagtagattgaaaaaataaacaatagttcaggtcgtttgtggagatggcaaatattgggcacacagattattgaagtttgggaactgtcaacatacatccctaacatcttttaccttttcatcaccatttatgtgtctgcaaaacttacctggctgtggttctcttatagtcactccagccaatgaaatggaagcaactgtgtgaaaactacaccagttaacttataaaatttcaatgacagaggatgggtaggtagtgaccgcaagaacacaatacattctgagaaatgtttcaatgttatcattttaaagtaaatcttagaattcctattagtgtagaagtaaactagcattacctattttgagcttaacacagtcaatgaaagtctttatcaatgaaagtctttatagaaagtatatatagataatttctataaagaaatttatattctatataatttctataaagaaattataaagacagaccaaacttttgacaaaaatctgcttaaattgcttaaaacatattttagtgatagataattgtttatttcaagaccttcacaatttgagcaatttagtgttgcatctgagaagacagagatggtcagttttttaaacaaatttacataaaaagatatgttaagattttattgataactattaagatctgctataataatatgtctctccatatagaattctcatatttatgtgaaaatgtatgcaaaaattgtggcttttaatatatgaaatttaaaaactcatatacaattttgctggcaaagcaagatatgtgttcaatttagtatcatttccataatcccaatttttattttcacctcatcatgattctgttaaacttggaagctctttttaaaataatttcatccaaaaccttttctgaggctctgatcccttagatcttgatctcctgtttaatttccctcagccattaacaggtgtggatttcattttctttgtcttccttgctaggaagtctaaccacagcattctcactgtgtactccaaagggccctggcctggctgctttctacatcaacctaatatgtgaggtcctttcatgtgaaaatgactctccatcatcagggtcacctcattcattcattaaaggtaatttagcacactcacacagcatcctaccaagaccagctttttgacttttgtcaaggtttatccacatcacacttgacattcctggtgggaatttctatgaattctgaagcttcagaaagatgttttgatatgtcccactaggggaaggaacttttccagggcacagagtgatatgaggcctgaactaactgggttcacctccaggcctgagaaagatgacatgaaccagaaaagcatggccttacagctggttggaaggagcctgtcttgctgaggctcattacagaactggcgcaagatactcagatccgttcattcccctggctgtgaactgttgcgtactgcagaagctgagtcagccttctacatctgggctgcaggtgtagcccagacatggctaattaaaatgccaggccttagtggtataggactctttctctggggcactgcacagctctagcatgtcatcctaaaaggtttatgcctgaaagtaaaagttcagaatattaagaagaaaaaaaattgtataatccctggaatgctaatgtcttgagtttctaaattgaacggcactgtcagattaggctctattgacatagtcagcaagttcttattcttcttgcctgtgccaggctgctgcatgtcaggacataaaatgttcccttcataggcaaaagaaagcacccgtgataagtatactattaaggaaaagtggtcagtgttcaggctgagttgagacaggagtggaatgtcatctttctcatgtagcgcgctttaatttacagccaggatggtcatttaagcttttacacactgtaataaaggtgtcccagcagttggtagagagtgaagcttgatctttggcttaaaagaatgagattgagatataaaatacctttaattgaagagatctgtatcacaagggttgtgaagttgaaggttttatacgaaacataactgctgtctttacccagaagagtagatataaacagcccggtcctaagtaaatctctgacaccccttcactaccatcccgcatgatactggcatttggtttgtttttcatggtttataagggttttcacaaacagaaactcgtttgatctttatacctttctggaagatacagtatttttattctccctttaccgagacttgttgcacatttgaaattctgcatttctagaacatagggctgcaaactatgtgatgtggatttaggagcatggggcattgcaggagacacataataaaggatccgggtgagagcagaggaagacacagttcccagatgcttggcacatagtgaggatgggaaagggaaggccaaagaatctggcagctctggctcagcagttaacctgtcttctgtgttccacctctctagaggatgctgcccaactctcagcgataagtatgtggttttaattggcttgttatcataatttgaagctacgtgtcctgcctgactagtctttaatgaggcacatccactcttgggctcagtcaagcaaaagaaccttcggtggactccagtttctcctatgaatattgccaaaggtacagggggctttgggtgccaataaaaacagatttcccattgattgacttcctgcatgcaaataatcctcctccctagggaacgcattaacaagagaaagctgagtttctcctcacaacaagtcaagtttattccgactcatttgtgtaaactggtctataggaacacacagataagacttgttgtgttaattagcctcatctaatcattccacactgtggacatacatcaaaacatcacattgtacccccaaaatacaatcattatttgccaattttaaaacatttgtaagaaacttactgaacccatacttgtatgctaagcccttaacaagtatcattttactcaaacaaaactgttctacttaggttccatggttgtcacatcattatcatttcagacaaggagaccaaactccagaagttttagtaactcatataagttatatggaaaatgaggtgtgaagccaaaatatgaggtgcagctgtgggaaaccaagcctgtgtacctagtgatcccaagaattatcccaccctatagatggaagtgcttttgattggtgccctgattcaagtaaatttgtgcagggaatttttggagattttccttcatgaaaagataactgattatgttgatatttctctacgtcttgaaagttttgttctatcttgcacaggttatttgaaggattcttttttttttaatatttaagggaatgaaaagatataagccttatatggatctatgcatgttttaacttttcaagtcttatatgactctatgcatgttgtaacttttcagttcttctttttcttttcctgtaagcacattttctgtgactcctcttatttcttcaaataggtagtccacaatgggaagactactcgcacacgataaatctctgctagacaattgtcagataattttaaggctgctagatgctactataaatacaaactggcaaagataacttagttctggagtttttcttagtcatgaactcattagaagagctatagtctcttgccattgacagcccagagaatgcattttccttgttctttgtgttgaaaaatttctgactttgtttcaaagaggtgttaagaggtgaggcatgttttcagaatcatactgttagtctcttttataacatcatcttccaaaaataaagttctaaggtatttgactgccattctgagtcctccttattctgaaaggatgaccaaagttttggctctgagagagaatattctaaaaaaggacagctacttcaggatataagaaaataagaggagagagagcaccatttcagtttaaaggaggaaagacatattttaagatattgctgaaactttgacattttgagttttagcagattcaaacaggagaccaaaaacgtgtggcccccgtgactcaactcattgtgggtgtggagacatggatggggggagccaggcagttcaattgtcagctaaatattagagtccttgagatattttcttcctgtgatatttgacctctttttgatgggtattatcatcattttttctcccccactgggagaaaatatggtgaaggaaatgaaaggtgaaagggatagcaaagaaaagaatggatgaatagtgggtagagaccaggcaccctgacacagggaaaacagggtcaaacgaagccctttggttttcttccagaaacctaaaaatatccacctcttgcctgattgacatttccactctgcttgccttatgcatgtgctgtaggggctgctaatgttgcttaactcacatgctccctgcacttttctgctgttagaaagaaaccagtcagttgggtaatcatgataattaaaaaagatgtaaactttcagagtggctgacacaaactcattacactaagctgtcttgcctgactgaactaacattaattccaataccccattacattctggcatgtaagaatttctaactaatgtggatatttcttccttcatttccttacccaactcttccctaccttccttcattcctcccttctttccttcccttctttctcatctctaacacattcccattgatgctgatgctgcctgtccaaagaacaaacttttgctgaactgtttgaggctaattctcccaaattgtaatgtgcatatagatcatttgagggtcttattaaagatgcagattctggttgggtgcattggctcactcctgtaatcccagtgctttgggaggccatggcaggaggattgcttgaggccgggagtttgagaccagcctgagcgacagagtgagaccctatctttacaatttcttttttaaaactagctaggcatagtggcacatgcctgtgatcccagctactccagaagctaaggtgggaggatcccttgagccaagagttcaggttataatgatgaggttacaatgagctatgattgcaccactgtactcaagcctgggggatagtgtgagacccaattctaaaaaataaaaaatacaaattctgattcagtaggtctgaggtgagacctgagactttgcctttctatgagtgttccaggtaatgctgatgctactgacaccagggcaacactttgagaagtttcaagacaatggtccacacatttccagtgggattagagataataacttttggccaggagtgatggctcatgcctataatcccagaactttgggaggccaagatagtgggatcaccagaggccaggagtttgagaccagcctgagcaaaatggcaagaccctatttaattttttaagagaattaaaaacaggtaacatttttaaaaagagagagaaccagttttaatgcacagcaaccaaccaatttgaaggattctttttttaatatttaagggaaggaaaagatacaagctttatatgactctatgcatgttgtaacttttcagttctaccttttcttttcctctgagtacattttctgtggtcgaacctgttactcagatgtgcatttggtgaaacaatttctatgcctaccttggaaagtctgtgcccctttcttcaggctaaaaggcatgctgcaggaaaccacatccaaatgtattcctccctttctttgtgccaaagagttggagtttcttagaactctagattttgacggaagtagatttcaatatctgcttcatcactatctatacaagttccggcactaactgattgcgccactggagctccagcttcatcactttcttaatccctctaagcccctgtttagaatgaggttgaaatggtgggtactcagtggggttgtggaggggcttctatgacagattatcagaacatgggggtttataaatgatagcttctaatattttgagatgactcttgttgcatttggtgtgtttgtgtccagaagaagacagagcatcctcaaacctcttatgttgcctacacttgaagttagaaaatatttggttttatgtggaccaaaaaccagaccattcttatgtaaaatgtgaagactcattgatgtttttatgcagcatcgattcccctgtcagggaaatcatttgggatttgcttattgttatgtgtaaagaatttatgaaaaggaccaggttatctgtggacccaggatgaaagtataacctgggtctaccaaaaggctcttccaaactcaagtacccttccttttggctggagctaccctcattaattagagctgatcctgtggatgaaggaacaagagggaaggtcaaatataacttcattttctagagggtgtgcctgactggcccactggcagctatgagatgtattatggattaaacagaagacaaaaatcaagcctcaatttaaagtttattaatgaagcacctggggggcatttagcatacatgagcttttgttttttaagaaagctgacagagtgatgaaaagataacaatttttgtttccattgaagacttcttaaaaacattgattttccgtccatgttaatcaagactctttgtggaaaatgatagaaacccaatctaaactgcttaagccgagaaaaataggtaaaatttattgggttaactaactgaagtttgcaaagttgtagctgatttgggacatgacaggaggcaaggggtcaaacagcatcaaattctaccccaccctgccccttcccccttcctctcttggtgctgcttcctcctggattggttttaaattcagaaaacatctcttcatgagggtgcaaggatgaccattagccactcctccaggcctattttcctccaggtcattcattccaacaaaacacccaactcctgcttcccagctggacccacagaagccctaggatcacatttcacaggcctggctttgccttactcacactccataaccaatcatattgtccaggggatggaattgtccacctctaattggccaggcctgggccacatcagccccactcaacccacgtaactgagaatgcaacaaggatgatttccctagtaaaactggggtattattccaagaagaaagaaagaatgttgggtgggaaaaacagcgatttctaagaacccaaagggagtaaaatgacacgttccttatagaaacttggacaagagatagagagtcccaggttttgcaacaaagttatgatgttgagaaacgttttctgatgtttgtcacaatcacaaacgaggtgtttgtgtcgaataccccacagtgtccaaagagttaatatttcagaggatgggagttggggaaacatttggaaaacatccacctgtatttcatctccccccttccatattagatttttctctccctgtctcttttgcctctttgtctatctctctctctctctctctctcacacacacacacacacacacacatttaaatatatacaatgagtttattcacctcagaagcagggatgtgacaccagctggagggtttcactaatatgattgaaatatggttaagtgattttcaagtatacagtgatttgcactgtgtaactataaatagatgctcagggggaaattctctttccccgatcctattgacttatggcaatgtatgtggagatccaagctctgagcagagtgaaatatgcctttgtattgcagttgctttctgccaaagatagaaatcactttacagaaaaagagccttattcccaccaggtgaaaagctgctcttttgtaataaaacacaatcctctggaaaaccacgttagcttctgtgtgctgctggatcttcatttagggaggcagcgtagtagcaagagcttaaaatgtgggcatccatctgccctcagcttgttctcttgcttggccttttctttccttggtgacattacctgcttagcttgtcaaacccaagcttccttgtttcttcaaagatttgacaaatttacctaaagcatatggggttatgaggatgaaataagataaaacacgtaacatggggcctggcatatcataaaatcactaaagaattggtgatggatgaatatatggttattgagtataatgggatgcaataaatggaacataatgattcaatgcaaattagggaaaacagcacttttattctgtttttaagaaactggactttttaaaaagaaaggtattaagaataccagcagtttttgtgacacttgtggaaattcatctgcctgggcgtagtttcctcatctatgaaagaaaatattcaaataggatctaaaattctcaggaaaacattcctgtgggtttagttttcatacattgtaaggacatcctaaatggtttcaagccaaagctaaccttaaagtcaggccaagcaatgagcaggtagtggcagaaactactaaaacattaaaattgcatttcttttaatacctgtatcttcatatagttagaaactgagctggacagtcagagctttgaattcaaatcccattctttcttttttcttttattctacatgaatgaactgagggcctggcctggcctgttctgtccgtatctctatgctatccatgggagttgtattttaattggtggtggtgggggggaataaaaataagtaacccaaaataaataactgcaaattatgccacaggctatgaaaaaaagaaagcaagcaaggaaacaaatattaatacaaatggtgccagcctcattttcatatagaaaggattctataagctaaggtgtatgagtaaaagccttcaaccatgtgaaggggaagaaggaaagcactccaaacagaagggaaagcaagtgcaaagcccctggggtaagatgtatttgaagactaaatgaccagcatggctaaactttagcaagtcggggacagtggtagaagttgcagttggagaaaggaagaggccagatcacacgtggccttgtaatgtgttgtcagagcttgcattgtcctctttgtgtcttgcaaaggacacatttaaaaaataaaatgttttatcttatttcatcctcataaccccatatgctttaggtaaatttgtcaaatcattgaagaaacaaggaagcttgggtttgacaagctaagcaggtaagattaccaaggtaagaaaaggccaagcaagagaacaacctgaaggcagatggatgcccacattttaagctcttgctactactctgcctccctaagactaatagaaattgtgatttgaaaccactcttgcttctgtaaataaacaagagaatataagaatggaagctagaagatcagttaggtatttctcagagaaatccagggtagagacaacggtgagctaaactaggtggtaatagtataatgcacaggaagaaatattccagtcttatccctggctgtgtgactgacaccaaattcctttttaaatccctaggactcagtttcactgtccgtaacatgagcaggtacaacacaatctctaagggactcgtatgtcaacattttattctaatttctaaaaatctctaagccagaccaactcttttgttaaatttacatggctttgatgcactgatttgctcttaccagctttcttgccaggccctagggtaaagatatgagattacctgccaagaaataagaaatgagtgcaagtcttattaagaactgtgggagttggctggccttgaaatggcattatcttttctgttttacgcttagggtggtttcaaaacagtctattcagttgtgtgcatgaatttccaattccaaattcaaactacaaatttcataaacccagattctgaatgttaagtttcattttatgctgtttaggatgatggttttcatgaagaaggacaaaagattaaaaagagctatgatgaaagttttattaaatgaaggattcaaaagagaaaactctccaaaccccatccaacatttttctgtctagtgttcagagaaaaatggtaaattaatagaaaagcaaaacagtgtgggatgccaatacattcaagaaaagccaaagttcatttctgcctgcagattcaaacactgctggcagatcaatgtgagcttcacagtgtggtttgcaaaaatcgttctgcagctaatatcctcaaggacaagacacagcctgctttggctactcttcagagtttgcctgaattgctgtgggaagcaatattttccactgggaggactttggagcctagatagttatagcacccataaatcaaatcatcaagatttcacaaaagtagtgaggatttttggtgtttgttcccccgccccgcccccgcccacatgtaactgtgtggtgggggctgcctgtctagcatgtgtatcattagccttactcagaagtctaatgtgtgctttaatttaatgagatgcgactgcttgtgcattctctctctctgtttctctttctttcttgttttgctgttttctctagaaatgattccattaccaaaggacattattttcgtcattttgttgttgttgcaaaattaacatagaccatatacaatttgcaaaacagaagcatggtctgggtgggacagtgaagttcatatttcttgacataggcaggcaaaaaagagataagttatattacatgttgtattatattttatttttaaaaattagttttaagtttgcaggataaagttaattgagatatatatatattaatatgtatttgctgagcacatctaacgaagaatttatggcaggtactggggtgatagcagtgaactagaaagcaagagtccttcctttataggtctaggactaaaagaggaggtaagcaaaataagcaaataattaaaatgtaataagtaatgttggggagaaatatggagggcaatctttgtgggggagtgaaagatgtcatatttaaagataactgccaaggggtaggaataaaggagagatgtccaaaggcttcaaaagaatgtgttctcttgaaggtgcagagcaaaaccagtgtggctggaaaggagaaagaaggaaagggggcttcaagcaagatcatgtgcattgtcagacttcagatcatccaaggccttgtaagattaggggacttttttttttttttgcataagtcataaagaaatcactgtgggggaatcaaacactaaacaggtatgcaagataatttcagataaagtatatgaaacaaaaatgggatagagcaagtttagaggagataatgatgaggaatgtcctctctgaggaggtgacatttgaacggagacctgaatgggacaaaagggctagtggagaagagatctgaagaaagagcatttcaagcattagagtaaatagggcaaaaatcaggaagcaggactgtgctgtttgtttaatacacagaaagaaagaaatggttaactggaatttggactcgggacttgagttcaaattcaaagttatttatgctgcccccaaatgcgactacctaactgagcctgctgtttgctaaggattaggggctttctctgtttcactagatggtaagtacctgagcatagggaccatgtcttcccacttatttctgcaaacttagtatctgggccctgtctagtacctgttagactctcagtaaatattcattgaatgaaaacatctctacaattacaataccctgactgtatatctactgttaaaattctaagactagaaaaaaacaatttaaatgttgaaattcagtcagccaattggtaatttaataacccaactaaaaaaaaaaacccagaagacaaaatagtcaaaccatttctaagagtagctgcagactaaataacaagaaaagaaaaaaattatctaaagcaacgcttctcaacgtcagtgctattagcatttggggctgaataattcttggtcatgggagctgtcctgagcattatttagtggcatcgttagtcgctactcaatagttactggtagcattcccctcttgcgacaacccaaaatgtctgcagacattgccagatggccctattgagaacactggtatgaaagtattaatgccatgccactttctaaaatgttgcagaagttgttgtgccacccagtgggttttcagttgatttgtgtgcaaagttttaccaagaggtatgataaatatgtcccctgagttgaaatactgtgtatcgtacatgcattcttagcagaaaacaaagttgcttaatattttattgtttctaatggtttctgatgagacatccatcaatgtaaaagaaaccagtttcttctaagttttactttataaatatgtaatataattgtagagtaaacctcctttatcatcctgatggaggatcagactaatatctgtcttgagttttatcaggattttatgctatttttaaaatagtttgtggagggagggaggaggaaaaggtttgatatgcaatatgttaaaatctgtagaataacacagttccacttcatcaagctgtaccatatagctttcctatacagttttaataattttaaaaataacttttttctgattttaaatattcaaagaatatagtcaagtatacaagaggaaattaaaatcatctataatcccacaattgagagataagtatgtacattattctttcatggatttatttattcctccatgaaattatgtgccaggcactgtgctaaggctggaaatacatgagaacaagatatataagttatctccttatgtaaaacctacttgcatatatattagtgcatacattagaatgtgtattccacctttattcataccagaatcataccaggacacctagatagttcagtaatgctttggctggcaatcgtttggctgtcagtgaagaaacctgaaaaacattaacttaaacgttaaggatattatctcatttgcataagaaatttgaaagagagtcaaccagggctgatgctctgaatttatacttctatcgattactcaggatccttctggctttctattgtgccacttctaagcatggaaccattggttctaagcttgcaaaacagcttctccttcttaaggtatttctccaggttccagactggaaaagggggaaaagccaaaggaaaaaaaaaggcaggtgctccccgaatctgagctcataaaagagctttctccaaacttaagagttttctcaataacatccatttatatgttattgtttggaactatttcacatggaccccaagatgcaaaagatagaaaaaatagaacaaacttacattgagttaaaagtgatggacagccttccaaaaacagatgtaatccttgcctccttctctgaaataacaactaaaggtttagtatcagacttctagattcttgtctaagtgtagagagatacgcacaaaagcattgaggtcatctttccatccccattaaaaggggatgatagacattttcctctactcaacaatatatcgtgacaacttttcaggtcaatacatttagccataagtcatttagaaataattgtacaatagtccatgctatgagcaaatcacaattacaaaactgtcccatcgtaacatagattctctcaaaattattgttattacaaataaagcccagtacatctttatacggtatccttacacaaatgagtgactttttctgtagataggctagaaatagaattgccaggtcaatatgtgtgaagcatgtttaaacattctaatgggtactctcaattgcctttcaaaaaggctgtaattatttacagtctcaccaacagtagctgtgagtttctttctctcttcattcacaccgacaatggatattatcagtcttaaaagactggtaatgtttcctaacttttcaggcaataatatgtctccagatggatttatttccaaactgtttatataaagaatttcacatacactcaaaagtagaacaaataatataaactaagaatcccactacccgtcacccagcttcaataattaccaatatattgccacacttgttttagctgcacagaatttaatcatttttctatttttgctaccatcccttttttattttggagggaggcaggttgttgttcatcttttacttcttattctagtaagaattttgatttcctcataagtcctatgtatttgtcttaaagctcacagccatgcatcaagttttctgtctagtgcagagatagtgccatcactttccccttctgcgcctgggtagatagtattacttgatcaatatatcttttagctgtaagcccaggtgtccccttgcaccttttcttagcacagtgctttatacctatggttctcaaacttcagcatacctaagaatcacctggaaagcttgttaaaatacacattcccacacccaccacccccatagattcgcattcagtaggtctgggatgggaactaagattccattctacatttctagcaagttgccagatgacacagattctgcctatccacacaccatggtttgttagcattgttctagaccagtgcttccaaattttaatgtatatatgaatcactggagattgtgttccaatgcagattttcattcagtaggtctgcttctggccctgatatttagcttctctaataagttccaggtgatactgctggatcatagactaaatttgagtatcaggtcctcagtggccactactatgcagagttggttgtgaagtaaaattaatcagccatgtctaacctagaaccaaggccttccttgacctcaaagtttcctaaatatcattacatagactagaaccaggatagctaaaaaatattcaactgagaaacttttcttaaaactcagatttcaagtctgtgcaatgagaaattgtccttcatgagaaatttggggaggggtccaggaatctattctttatacagttcttttgccaaccttggagcccaggtaagtgtggtagccactactttatgcttcttggatgatgcacaggtgttcattcttggattcatctgatccctcacctaattattaatcttatcaagataaaaatgttgacactgactttttacatgactacattagatactgtgggtcatacagagatgaattagggacagattctacttctctagacctgataatctggtgaaagagattgatgtaataatacatagtcactactatgggaagtcagggcagaaaacctgtttcctctccttctcggtatcctccttcctgaaacttaaattaaaaacatttgctcaagaggaaatttcccatttcaaatagaaatctcataaaagcatagaaatgccaaggagatagttttctatgtaatattaagtcataatatgggctttgctcttgggtggcgttcccagatactagctaggtttgtaagtataacacaacatgtgcattacacagtacatataacagtgggaaaatgaatgccacctagagaaccataacttttgtcatttcttgactttggagaaatttcaatttgtagccttaatgatatacaactgtagatttttccattttaagtaatatgctgattggagtcttgcatagtgttcttattttcccaaattctcatcctatacaaaattcgcaaattcttgtattcccaaattatcatttctatacagaatgtaaaaattctaataaagctaatagtgtaggtcatatatttactgtctgctgaatggggctgttcactgtcattaagattctgaaagaagcacttgagaaaacaggataatggagaagaaaaagctgtaatcaagcataaaaggacttttaaaagggggaactgagacatctttcaacagtgacctttataacactgatactggactgagactataattgtccatcactcttttcaatggtcaatactctgctcaccacaactcattctttcaataccattgatccgtttaacaaccctggctggcaatctctctttgtaagttacaaagttagtgacatttattctgccctgtttggtggttcattgttaggcagtctcaacattgtatgtcttgatgagtgcagtctggtaagtgaattaggaaaattttcagatggtaaagaccgctttttaggcaggatatcatatggttaaagggaagcatggtataaaccagcggcttcacatcattacaaaacaaccctacctccacttttaaagaaattgaccatgcattgagtggacttttgttttttttttcccccttctgcacagtgggatgattagaaagattttaatttgaaggagaacccaaattatatcactttcatggatctaaaaatttgggtcacgggacttcagggattggagagaattgcaaagatggagatgcaatttgcttaagttgttccagaaataggaatcacatgacaataataaaactgcatttactctcaggataataaccagtttcttcagataagttcagatcttggttcttctcaactttgtgttcttaggcaattagtcttatcctctctgacacctaatctcgctactttttaatgattataacaccagtatctattttaaaaagtgttttagagaattaaatgagataatatttaataaacagtatttataatagtgttctttatgatggtatgcaacttatttcttattcctatggaatattcttatggaataagaaatccattaaatttctaataaaatattttacaataagttatcattttaattttttatttacattgttccttttgattcttacaacagccctgtacaataggcatgataaatcttttaactgaggttttatagataagtaaattaagtctcaaaaggttaaagggaagaatggatataaactgtcagcctcatacattacaaaacgacttaaaattccacaaaaagaaaatactataccatgttttttttgagattatctttataccatgttaatattttattttcagtgttttaaaaatcaggactgctgaaagcatggtaggatatcaagctctaggagtagttatttaagatagtttgattttgctgggcaccagtttccacattaaccttttttttttttttttttttgagatggagtctcactctgttgcccaggctggagtacagtggtgcgatctcggctcactgcaacctccacttcccaggttcaagtgattctcctgcttcagcctcctgagtagtcgggactgcaggcgcatccccaccatgctcagctaatttttatatttttagtagagacagatttcaggctggtctcaaactcccgacctgaagtgatccacctgcctcggtctcccaaagtgctgggattccaggtatgagccaccgcgcctggtcccatgggaagtttttacattgcgtgggatacttaaaagagtggatgcatttgtggcaccattattcacttttttgacttccttataataaaggattgatatttctgatccacagaagagagtggaatcattgttttagtccattctcacgctgctaataaagacttacctgagactgggttatttataaaggaaagaagtttaattgacccatagttcagcatggctggggaggcctcaggaaacttacaatcatggtggaaggggaagcaaacatgtccttcttcacaaggtggcagcaagaggaagtgctgagcaaaagggagaaaggccccttatgaaaccatcagatctcatgagaattcactcactattacaagaacagcagcatgggggtaactgccaccatgattcaattacgtcccattgggtccctcccatgacacatggggattatgggaactataaatcaagatgagatttgggtggggacacagcccaaccatctcaatcactttgctctcttttcattcttgatgacggtgatcatggacaacaggcattgcacacttacgacggatcaggcactgttctgagtaccttgtgcatccttgtgcataatccttccaatgactttgtggagttgtgacagtaaatgtgtcataaaaaaaaaatctctaagtaacagtaaaacacagccatttgtgtatgacttacttcttaatacaaaattaagagctttcaaggttccccaggcaatgtcattttaactaccttgcattctgatgcgttcccttgaatgtgagacaaggaagcacagttagagcaaactcatggagtccacacctgggtacaatccagggagtgtgttctgctccttggagaacatcgtctgagtatcatagcaaaatcaaggctgggaagggctatcctaaagcatcttgtctgtgaagagggaaattgctggctttcattctctagtgaatcaagcctgatgtatgcagcaattttatgtttaagtcccccaaccttttatttcaatgagatgatctgaagtatatcaaattccaggttaattgattccagatctgttcttgctaaactgttggtcagctgatccatgaaaggggccttggagcttgttatcagatgagctgagattactttctggtcctgaattatactagggtttggggtacatatcttaaatttctctgaaactcagttttattcataatacaataggaatccaaaggaatcctattgcataatattttactttatggctgattttggaaggtaaccttcctcattgaagctgtgaatctactatatttttaaactctcagaacaataaagagatgtaatttgctttatgataatagagaattaatacttaaaccaaataagtaaaccctgcacacaagcaggaatgcttgaggccattctgctatacttcctcaccctagaggtttgataactatgttaaaatgcaaagggggcaagagccctgaatctgcatatgactggagattcagtcttatagtctgacttttcttatagtctaactagctgtttctcaagcttcagtatgcatatgtattactgttttggattatacacaccaagtcaggtatggcctagtttgagggcaattaaaaagatttttaaagtaatttatgcataatttttatatctctaaatctaatacattcctcatcattcttgtaagataaaacaccatgactttactacattcctgggtgcatcctggccctgagcatttgcagtgagcgcttctaaatgcctctaagcataaatttccttttcagtaaaatggagtaataaaacccaccttgaagtatttttgtgaggacttaattagattcaaaattatatctacacaaaaggtcttagcatatgcctggcatattataagtatctagcaaacattacttcccttcctagctatcctacctcacaacacatcccacagcacaaagcagggatgggtaatcattcctgcctttaagagcatgtgtctgtttttatcagccctcagcttccttttatacattgcatggctgcataattggcaaaattttcattgattagttgaatcctcctggataaatggttgtgcagttttcacatcccgtcaagttaagtaaatgccataagtaaaaggatacatcaactttaaccagaagccaagacctgatatttcctgcaatggagaatgcctgttgctccttatgatgttatctgcagctgaccaggttgtcattaggcttttgatattgaatctgtgtagatacccaccttggccaagttattttgaaagacagaagaattaaatgagattggaatctttctctttctgtgtttttcgtccctactatccttaattgaacttctattgatgtcagaagatatcactttaaatagtaggcccctactaatgtttcaatgcttctgaaagttgttgggttattcttaattttcttgcatggatttgggaattaaaaatacatgctatcactgcaaatccatcagaatggccaaaatataaaagaatgataatattaagtgttgatgagaatgtggaaccaagggaactcttgtacatttttggagagaatgtcaaatgttacaatgttaaaaaaaactttttggcaatttgtaatagaatatatatctttcctctgacccagaaattctttcactaaacatgcatcttcaaaaagattgtccaatcatgcttttagcagctttcttcgcagtagccaaaattggaaactacctaagtgtccatcaataggagaatgggtagaaatgaactgtgctatgttcatacaacagaaaactgcccagcaataaaaaagagcaggccaggcatggtgattcacacctgtaaactcagcattttgggaagctaaggcaagaggatcatttgaggacaagagttcaagactatcctgggcgacatagtgagaaccccatctctaccaaaaaaaaaaaattgttttaaattagcatatgtctctagtatgctactgcaatcctagctactggggaagctgaagtaggaggattgctgaagcccagtttgtgatcagcctggaaaacacagtgaaaccctgtctctacagtttttattttaattagccatggacaattaaaataattaaaataatggcacatgcatgtagtcctagctactagggaggctgaggtgggaggatcacttgagcccaggagttagaggctgtagtaagctatgattgtgccgctgcactccagcctgggtgatagagccagatcctgcatgtaaaaaacaaacaaacaaattgcaaatgcattcaacatcatggatgaaactcaaaacactatattgagtgaaagaagcaaggcaaaaagagttatactttataagtccattgatatgaattgcaagaataggcaaaaccaatctatgctggtagaagtcagaatagtatttactctgagagtacctgatgaattgtagggacataaaggaactttctgggagggtgaaagtgttgtaagtgttgtaaatattgatctggatggtgcttatatatagatatgtaaaaattaatgaagatatacttttaagatttgtagattttactatatgtgcatatatgcctcaaaaatttcaaaaaacatatatatatagcaacatatatatatagaaacatgtatatacatagcaacatttatatatagcaactatatatatagtgctagaatagatttattaatataaggtaagatgtaccacagaaaattaatgactttatataaaaaaccttctgaatacccagtttcttcagcaaatatgtggcatgagaaaggggagtaagaagtaactgttacagattaaaaatgatttgagacatatcaatcacatgcaatttatgtggatttcgtttgggtcctgacttttttttaaatgtgaaaagatttttgagtgtgatcatgcaattgtcactaagggtgaaatgataaaagtaatgagatttgcattaaatatttcaaccaacaacgtgagagcaaagatatgaagcaagaatggccaatcattgaatatacggcccagacttatgaattaggagactgaaacattcagcacaaaaatagtagaccaggccaggtgcagtggctcatgcccataatcccagcactttgggaggctgaggcaggcagatcacgaggtcaagagattgagaccatcctggccaacatggtgaaatcccgtctctactaaaaatacaaaaattagctgggcgtggtggcatgcacctgtagtcccagctactcgggaggctgaggcaggagaatcgcttgaacctgggaggcggatgctgcagtgggccaagattgcaccactgcactccagcctggtgacagagcaagattccatctaaaaaataataataataatcataacaaatttaaaaaaattttttaaattaaaaatatttttttaaaaatagaccagtattaggtgagctgaggggtgagttaatgagtctacgttagtccacggggctatccaagagaaaactgttggctgtgtgagacaggagctcctcactgaagtctagcgtggagagaaagatgtcaggctctctctgaagttgcagccctgagtttgaaggaaatcagatcaggaaaatatttggaatggacaaaaagagctagcagaagccaagaccctcaacactcagagagtagacaaaggaactagagaccccggaggatgcaaagaaggattaataaggaagaattgagaggaggaaaaacacccaagaaagttaggaattgcaaaaaccatctcttgaatttcattcagaaagtattttctgagtacctgctatgtaggcactggaattgagttatggagaggtcattgctgacatcttcccgaggctgtcccagaggaatatgaggagacaagcacaaggttgtagtaatagagaataatcaagatacagagtattcactctaactagaagggtaagagagaaaacccgtacgggaaatgtgagagaaaaactctctattatttgtgctggtataacaaaaggagaccacctcaacaggacagccaggccccctgacatcaagctgttaacagggccatccttggtgctgtacaattggaacagaggctcatcgcacttccagcaagggaaacacagcagttgtggggcccccgcagtcagccacagcacaaagaaaaatgccagagaacagtcagttctcaggcctagaattaaaagtgatcagctttcatatttcctggggctctgcatgtccaagtggagaccctatttgccaagtctcggccctcagttaatttactttccttttgcttttccttactcctgaattgaattatcaccttcctgaaaaaccgcgtgtgtaatggaaaagcggacacaagccaaagtggaatatagcagcccaaatgtgactcccattatcgccctattacatgaggaactggctgctctttgcccttcgttcatctcctgctgactatgaaaacctagtccagccgctttgttttaatgtcagctgttctgctctgacctttgctgctccctcaccctcctccttgagagaacagatgagttccatttggggttgaagttattgtgcatgaaaatcaccgtaaggggcaatgagatttttttctttgccttcacaggacagggagcattaagcaccactctctgtcccttaaagtccagaagcgtgcatctggcaccctgtgagaaccttctcaccacactcttcagtcctactgacctcagttttgcatcatttctcctcccaatggctttaaaggtacctcctgttgcttccgtatgcattttaagtgttttaaaaatacatctgaggaaattattttaacagtggatgtttcctggcttgcattgcgcactatataaacttccaattagggctatttatccttccgtccgtgacgccccgaagcaaggcccatttgtgaaatctaattatacctccttatttgcctggattgaagaacatttttagatctttcaacaggcttacttctcaggtctggaggattttgctttttgtttttgttggggggtgggggggctttttgaaaatttttttctgagtaccctaaaatgattagatccattttgtttaatttttcttaaatatcgattttcacaggccactgtccaggagccatggtaaattcctgttagtgaagcgctttccttgggttccgaagcctcctttgctctcaattctcattactttgctctctggtcatgggtgatctcccctctcttttcatggctgagagttcacggctgtttctaatccagaattagcagaagtagaaaaatctgctccttgcagtaataactttcccacatatgctgctgctcactccgcagtgcaaaacagagccgggttccaggcccacgtggatccctgacattgccataggcgcaaaaagaacatttagttttttaagcagctttgctaaggtaaagctatccttgggcttgtatttgtgttgaattccaagaagtcagtgaaagcgaaatgagccaaataaaatgcagaatgactctgggaaacttccgtttcattggctcagcttcctggagaatttgcccatggaagattatgtcgccatttgcaccaagttggtgcagctgtttgtcaagcaaggctagattccctttgtttgtattcttacctcgcccacatttttaatgatgtctatcctctatttctcatccagacatttttgcctatctgctttcaatgctaatgtctctctgtcctgtttccaaattaaatatcatacttaaaatattaataccccttgttctttgattctttgtttattcgtcttatgcaaaacataacagtgagaactccatctgtattaaatgctactgtatgggcagattcaatgacttattaatgactgtttcatgatatgggagagccagggctttatataatcatgcaattcttattcaaaaatgctctgctagtactagcctgtagggagaaaaaatgaaatatgcctatcttttcaaagataaaaatgactagctttgtgaagatcattgtagaaataactaagttttgaaactaggccaagttacttcagtttccaaggaggttagctcatgtcttgaagtatttgggtacatacatttttgtagcatttattgaagtgaaaaccacatatcataaatgtacagctcaatgaattttcacaaagtatgtgaccactgcctggtgaagaaatagtatatttttaaggtgcctgttcatgtctctaacccatatttattagtttctgctttttaatacataggaattgtttatatacagtctttacatatgttgcatatgaattttctgttcattatttgtattaacaaaagcccactatataggttgcactttcactcttctaatggtgtcttttgttgactctaagtgctccattttaatgtggtccaacttacgactctttcctctatggttcatgtttttttgtgtcctattttaaaatctctccttatcccaaggtcataaagatagtctccattattattttgtagaagcattactacattcataattagagctacatctgcccagaaacatattttggtgttagtgtgagagtcacaggaagacactggaatattcttaggagaggcttatgggctagctgctattttataaagaccttcttctctgctttgtggaccaaagttgaagcaggaggaacatttagaatgttctgctgcactactcctggtgagaaatgattatggcttggatttgagtgaaatggcaatgagtagttggatgtgatctgtgttttagaaactgagccttcaaattttgcagatgaatagaatgaggaatgagggaagaagagaaattaagggtgtctccttgcttcttaatttcagcaacgggttgagtaatggtaatgttatttaagattcagcaggcaagagatttgtggagcaaactgaataattctgtttgctgaggttaatttcagatgaatcatttaagtggaaatgaatgaatggatgagtaaaccaatggacttgtgtaataaataagcaagtaagcggtagaactaggcacccaggtgccttgactcttatgcttaaaattaagatttttatccattatacaaatataacccagataatattctgttgaactttagtttcatagtatcatggaaaaataaagattccctggtcaaataatttggcatatttgatgtaacaaccctcttgataatttactgtatatattacttatgtttctgagaaattctgcaggaaaaagttacttctttagctttagttaacccaatatttctcaaatttatttttccataaaagtgttcttaaaggaagacctgcaaacgtcacacaatactagtattaatgttctatggaacaatctttgggaaaaactattattcaatctactaccatgttaacatgtaaaacactacccttaaaatacacaaacagtaatcattattcttgttcacatctgtctatttctgtaattttatatgagtagtgaatgtcttttaactaccctttctcaagggcagttcccccatgtcataataattgaaaattaagaagttacagagtcataatgaaattgtcccctttgaacctttgttgactgaagctgcatattaaccacatcccattcagaccaggagtaacaagaaatattctgaaccccagctgctacaagataacaagctttgacagcttcctaattaccttactatcctatagttaaaaacactttaatactatagcaattctcttctcttcacataagtcaaaagatatatctaattttctccttaattgatatctgtattgctgctttaaaaagaatgcactcctccaatatgtttaactattaatttataacctttgatctgaatgtgggaaataattttaaaaagaaattacttgttatcaactgtgaatagataaatctgaaagcctcagctcaaagtggatttaatccttttcttaaaaaaaaaaaaactcttttttcctcaagatctaactttctatttaataagttcttgcatgttttatttcactctgctaagctttattttttttcacctgtagaatgggggaaaataacagccttagtgtcactgtgaacatcaaataaaaatgatgcatgtaaaaggattagaacaggatctgacccatagaaaatattcaagaaatgttagttctatgcacctcagttatgaagatttttggatctgacagcaacatggactcaatatataggtgttgaatcgaaataacttcagctcacattaaagtttcctttattacgttaatagaataagagatatttagagctagagtctcggactgtaagatgttgtctaggcccaaacacaattggcagtgcaactgtgaacaattgatggatctagaaggcacttaagaaaataatgttatagtatttacatattttttttacatgcccagtgctttgttaaaccctttacaggaatgatctcagttaatccccaaaacaaggtgagtagtattgcagatcccatttacaacaatatattaggtctagacttacccaagaccaaagagctattaagtggtggagggagattttgacctaagactgtctacatccagaacttatactcttaactactctacatactactgttgacagaatcttgtgaaaacgagtcattgtataaaaaagggagcgaaggccaaaaaacgatccacacgttaaggtagtgcagaatcaatataacatagaatgttcattccccacaaaaaaaaaaatctggatcatgttaaaaaaattttcaaagtattttgaatcaaaatgttatttatgtccctaaaaccacaaatcatgctagactgaatactcccttccaaataaatgcatgcttatttagagaatcctgggtcacctgccatacaagggataacagaaatgaaatgctttgtcctgtctttaaaatctaatcatctagtgggagataatacagtataaggcatctgatattttctttataaatatctgggaggtggcttccagaattggagaattttacaccaatgtagtaaaacatatatataaccacagttttagctaatacggtttcagttttcactcatgtcgtttactctctcatcaccatctcccctcctagccaaaaatcaacctagacatcaattatgcttttcccctcacatattccattagatgttatctactctatacagttaagcatatttagaacatttagtttacctacgtatatataattcttagtagctgtgtcttatctacccagagatttaaggaaggacaaggcatctgtcctcttttcccagaccatcttctttatggcttttcctctcagtcttcttttacttatttaccatacgtactcccattgcttgagcccgacagatcgaggctgccgagagctgtgattgcaccacagcaccccagcctgagcaacagagtgagactctgtcaaaaaaaaaaaacaaaaaaaaaaacccaaaacaaaaacaaaaacactttttaagattttcatttacatatgttttaggtttcatgtaagtgttttcataatcgtttgcctctttcctttctttttctttttaaaagacaaggtctcactctatcgcccaagctggagtgcaatggcacaatcacagctcaccacagcctcgaattcctgggctcaagtgatcctcctgcctcaaccttccaagtaggtgggacttcaggtgctatgccaccacacctggctaattgttttgttttgttttgttttaactttttggtagacagggtctcgctatgttgcccaagctggtctagaaattctggcttccaaggatcctcctgtcttggcctcccaaaatgctgggattacaggtgtgagccactgtatctggcctcttttcattttgatcctgtgacagctactagaaaaacaaacaaacaaacaaacaaaaacaatcacttccttattcttatccacaggttagattaagaggcatttcattgattgcttcccttatattctctcatgaattctcaaaagctacgtattcaatcctgtaccttttttagactgttagtataaaaggatgactttaaaaaaaaaatgccttaggtttgtactaacagctacaaccttctagctgaaaagttcactgggagatttacctctgtaaaccaaaggtgtctaacccttcatagttgatgagatgctttaatagtataatgaaagtatagatcctctccccagggaaaaataatcatatgctggcagcatgttgaaatagcatcaggatcttcacatgctttctgacattcacccatggacctcagattaagaatctctctagatgatgggttgataggtgcagcaaaccaccatggcacattacctctgtaataaaactgcacattctggacatgtatcccagaacttaaagtaaaataaaaatagaaaaaaaaatccctgttgtagatcaaccccatcagttatcttggggactgaattaagtgtaatggttaattaagagtgtgtactcaggatcaaataaacaaggactcaaaccctattgtcacttctttctagatatatgatcataggcaaactgtataaccagtcctgtgattaatagtagcatctgcatccttgggtctctgtaagaattaatgagatattgcatagatcaggacttagcatggtgcctggcacatgtgcttgatcaatgcgagctattgttctcttcataacgcatttgtatttaatatcttaggtttttcagcagaaacagaagtcagggcaaagaagctggtctttggagacctttgggggaaattgaagagcaatttccaggtcgagaactgtggtgagaaaggcccttttgatttcattttgaggcccactgagggactgctccgtctatccctcttgtgaaagaggtcagggagaaaagagaaccttgtcaaaaaacacaaagaagcagaacttgatcaaagtgcagagaatgtctctgcaaagctattgattaagatttaggattttttgttcatttgctgtgaaatgcactcagaggaacattactaaaacatactctcagcagttaaaattgcctctgatttgatgttttcttgagtccttctttattttagggaatattttataatattcttcactgtcaaattatgtaataaacaacaacaataattcaaaatttaattttctatgcacaattcttccattggtcaaggaatcgaaaggacagtgtaattccgaacaacactgcccaatataagtaaaatgcaagccacatatgttactttaaattttcatgtagccacattttaaaaagtaaaaaaaagtgaaattacttgcaataatgtattttatctaaccaaatatatccccaatatcattttaacatgtaattggtggaaaaatttattaatgggatattttgtatttttaattttataccaactcttcaaatccaatgtatctatgacactttcagtgtatctatattctgacaataaacgttcaacagtaaaagtaaaatgcagttctgccaaaacgattaagtcacatttagagaaaaaaatgttttatactatttccatttttcaatttacatttaaataagattaaaaattcagctcctgggccaggcatggtggctcacatctataatctcagcactttgggaggctgagatgggcaaatgacttgagcccaggagttcgagaccagcctgggcatgatgaaagcccacctctacaaaataaaattagctgggcatggtggcacacacctgtggtctcagctacttgggaggctgaggtgggtggatcgtttgagcctgggaggttgaggctgcagtgagccatgatcgtgccacttcactccagcctgggcaacagagagagatcgtgtctcaattaaaaaaagaaaaaatttacttcttgaatcacacagccacatttcatgtgtacagtagccacaaatggccaatggttatattaggcagcaccggttcacagggaagaatctgaatttagagtcagaagctctaggtgtgaacttgcttctcccatttgctctctgtctttgcacaattcactatgttctctaagcctcagttttgtccccttcgctcaacctcctgagccctaacagttgaatgagataatgtgaagggaaagggcccagagaactgtaaaatgaaatgtaaacataaggtattttaaatttaataatatggagagagttaattatttagggattttgaatcagattccacgacatttgtggaggcagaaggaaatcatctcctttaagtattgccaatgatgattataaatcctaaagttaggatgcagtgggttggtagctttttaaagcaattctttttcatactttgttaggaaaatcagtgcttttatcttgactctaagttctaagacctattttttcagttaaaaaaaaaagactttttaagtctatttaaaaagtttaattgacaacacagtcttagtgctgtgtgtctgtgtgtgtgtgcatttggaaaagaaacacacaaaattctcaagcctatttaccctcacagagaaagaaggaaaggagagagacttgttttgcttcattgacttcactggtgtttcagttttgttttattttcttttttgagacagggtctttctctgtcacccaggctggagtacagtgatgtcgtcataactcactgcagcctcaaactcctaggcacaaacaatccttctgcctaagcctcccaagtaaccaggattacaagcatgtgccagtatgcctggctaattttctttctattttttgtagagacagggtcttgctatgttgcccaggctagtctctaactcctggcctcaagtgatcctctctccttggcctcctgtattcctggcattataagcatgagccttctgagtagctgagaccagctatgtttcagttttgaacagaaagatatgtattatttttgaaataaaaatcagtgtagatgaaaacaaaatcatgttatataagataaagagctttgattctctgtcgacaacagataaagttaatcttctttggaaaatgagcaccattattatacatgagaattaatatagacaaaccaataaatcatagctacttctcatcagggatccttgctctagagaattgcctatgtgagctacaactttaccaaagtcaacaccagcaatctggaccgcctaccctcgtgactttttgtttcggttcatatttgacatccatattgttgtttttatctacagccttttaaaacatgtgacttgtctgtccacatggtatcctgttgaatttcagttttagcctctcaggagaattactgcctgtttggttgaattgttcccaagagccccttaaatgaatttctgtcacatatcccttgaaatctctatttagatcacataatcctaaacatacccttggaatatgatacaaattcatctaggtgttttcatgctaagcagccacagaaagatagaatcaacttaatatatttagattatccttaaaaataatacaaggtatcaagtgatttttaggggctcaaaaagatacttactcaaaaaaaaaaaagataatatctcctgcataggcccttaacaaactggcttttaggtctctcttgaagtgactagtctctatggatacacttcctgtttcaacatacaagctgcccacttgtgtgcccttatattaatatacgtaataattattgaaagtgtaccatgtgcagacactgtgctaggtgcttgggttacaatggtgaaaagatacagacatggctgctacccttaacgagcttgttatcactggggagacctgttcatcaaataacctaatggaaaaattaacagtagtaaatagcacataaaggtgggaaaaatgatgctggagtgtttggggaaagtggcctaattggagatgtcacagaggcttctataattgaactgaaacccaaaatatgaaagagtgttaaccagcccataggagagaagaagggtggatcttgcaggtagatggaacagcattgttctgaaaccctgaggtagaaggtaaaataggacattcaaggaggtcagagcaagcccaggtagctggagattagaaaataagcaggtatataacacaagatgacgctgaaggggtagtagggtatcagaccttgcaaaacacagtagaccctgtcaccaatggtgatctttattctaagtgaaaccaaagtaagtacccatttgattagggtatttctcttcattggctaaggttgtagggactacttaaagcattaaagcatcactagcctatctttaattttctacagaagccaacagttagcatggaacattcctaagtcttcagaatagccactctcaattctgggtcttcaccctgagcccctgggaaaatttacaacaaatttgatgacagagacaccacagctacccccaaccccaattcctagagattctgactccacagatctagggtgggacatagccatcgttatcttttaaacattcggctagtgattctgatgggcaataatgtctgggaactattgcattcaaaattcagttttgtgtattcctcttttaatgatagatattatcaacctcagtgaagtagataatattattggtcatttttgaaaattatttaatgaagaggaaagtttacagcaagatcttcctctcctgatatcagtgggatttctgatcattcattttttttttttacatttttggggtcttctgtattaagaatatttctatatgttcatattccttcttttgctttcctccttgtgaaattttctttgtaagttaatattctatttattttgaaacttaattagatcaattattacaacaagctcagtaagtctagcattttccaatagtgctatatttatcttgtttttcactcaataagaacttactgtgatataatgctttcttgcaattgatttaatttatactttctgaacacttcagaagtaatataacagtgtttccctctcagacaaaattgtttccttgcacttggagatgttttccctgtccattagttctttttcatccattaggcagaggaaatgtctgcacttcctttcatcttccccagtgagcctgtgccctcagtccctgatgaacacagggcaagctaatgacaccccatcttggtagcagccagaggtggacactacttctagtggagccacttagatatttcttgcaggagtttgaactagggatccaacatattgaattagttgatttggactacggaagtgagggtccatgtaggggctgaagagactataaataaccatggacaggtgaatgtgtgtgtcatgctgagaagccatttggggaggggacatcaaaagaatgaaatgaaagggacagaaaaaggaggacattgaaagggtttgcagcagtgatcaaaaaatcttgtagctaagggagtggaatccataaaaggagggacaaaaacacttatatggtttagctgtgtccctacccaaactctcatcttgactcataatcctcacaatccccatgtgtcaagggagagaccaggtggaggtaattgaatcatgggggtgttttcccctgtgctcttcttgtgatagtgagttctcacaagatctgatggttttataagtgttaggtagttcctccagtattcattctccttcctgccactttttgaagaagatcccttgcttcccctttgccttccaccatgattgtaagtttcctgaagcctccccagccatgctgaactgtgaatcaattaaagctctttcctttataaattacccagtctcagatatttcttatagcagtgtgacaatggtctaatacagtaaattggtacctaggtagtggggaagtgctagaaagatacctgaaaatgtggatgtgactttggaactgggtaacaggcagagaggttggaacagtttggagggctcaaaagacaggaagatgtgggaaagtttggaacttcctagagtttgttgaatggttttgaccaaaaatgctgatagtgatataagcaatgaagtccaggctgaggtggtctcagatggggatgaggaacttcttgggaagtggagcaaagttccacatgtccaggatggcacttcccactcagagaatgcctttggtctctcccattagattttattatgacctcttcatacagagcatttccaaaagacagctaagttactctgaaaaataaacaagataaacagccctagctatgctttagcaaagagaagggcagcattttgcccctgctctagagatctgtgaactttgaacttgagagagatgacttaaggtatctagcagaagaaatttctaagcagcaaagagttcaagatgtgacttgggtgctcagttttacgtattcacaaagagatggtttggaattggaactaacgtttaaaagggaagcagagcgtaaaagtttggaaaatttgcaacctgacaatgcaatagaaagtaaaaacccattttctgaggagaaattcaagctggctgcagaaatttgcataagtaaccaggagccaaatgttaatcatcaaaacgatggagaaaatgtctccaggccatgtcagtggtcttcacggaagtccctcccattacaggcctggaggcctaggaggaaaaaatacttctgtggaccaagtctagggctttgctgccttgtgcagtcttgggacttggtgtcctgcataccagctgtggctaaaaggggccaatatacagctcagaccactgcttctgagggtgcaagtcacaagccttggtggcttatttgtgttgttgggcttgtaggtacacaaaagtcaagaattgaggtttggaaacctctgcctagatttcagaagatgtatggaactacctaaatgtccaggagaagtttgctgcaggggcagaaccctcatggagaacctctgctaaggcagtgtggaagggaaatgtggggtgggaacccccacttagagtccccacgggggcactgtctagtggagctgagagaagagggtcaccatcctccagaccccagaatggtagatccattgatagcttacaccatgcacctgggaaagtcataggtactcaatgccagtccatgaaagcagccaggagggggactttaccctacaaagccatggagacagagctgcctgaggctgtaggagcccacctcttgtataagcatgacctggatgtgagacatggagtcaaaggagatcatttggggactttaataatgactgcccaggtgtaattcagactggcatggaagctgtagcccttttgttttggctgatttctcacattagccaaatgtgagaacaaatggaaaaagaacatttacccaatgccgctacccccattgtatcttggaagtaactaaattgcatttgattttgcagattcctaggtggaagggagacttgtcttatctcagatgaggctttggacttgggcttttgggttaatgctggaatgaagttatactttgggggactgttaggaaggcatgattggttttgaaatgtgaggacatgagatttgggaggggccagggcagaattctatggtttggctgcctctccacccaaaatctcatcttgaattgtaatccccataatcatcacgtgtcaagggagagaccaggtggaggtaattgaatcatgggtgcagtttcctccatgctgttcttgagatagtgagttctcacaagatttgatggttttataagtgttttctagttcctcctgcattcatttcccttcctgccaccttgtgaaaaaggtgccttgcttccccttccaccatgattgtaagtttcttgaggtctccccagccatgctaaattgtaagtcaattaaacctctttcctttataaattgcccagtctgaggtagttcttaatagcaatatgagaacagactaatataataggtctatggaattttatcacatacacagaatcgtgtaaccactaaacaaaatatttagcacctttagtaaaggtaatacattcacatggttttaaaaaacaatatttaaaaaatatttaatgaaacatttcaatcctaaccccacccccaatttatactgttccctgtcccattgtcacttttactgttttcttctgttgtccttccattaattctccttgaaaatacaaagcaaaattaccatgtattataaacttcatcctccttatgtaaaagttatctcactacataaatttttctgcacctatcttcatttatcttgttggagatcattttataccctcacaaaatgagcttcctaattctttttataggtgcatagtatcctgttatataaaccctgcacctttaacttgcttgagcaatctttgagtggttttttaaacttagaaactcaagatacaatatgtctcacaaaacaagagtctcagtaaagctcaaaagaaggtgtccaaatgtggacagtaaactctggcaagtttaccagatggtgaggagtaaagtggccccctgtctggaactgggaaaagtaaagcagagctaaaagcagaaagtacatctctctgcactgaaaagatggatttttttttaagtcaaacagaagagcatctgaactatttaagataatgaggtcataactgagttaaaaactagcattggagactcagccaatactctaaaaactgtcagaagtcggtcagatgactgacaactggtgcttatgtgggaaagcaagaaagaacatcatttcactgtctagaccaagttgaaagattgtgtttcagaatgatagcattgattgaatgtacatattttgggaatatattttgttttggtaagtttattcagttttatgttcttagtttatttatatttgtattcgtagttcattggtagatttattcagctttttagtcttagttcattttatcctagttcttttgtattaattactcatttttatatcatgttattttagcttttgataaaatgatgaaatattatataagtatttgataaaatgatcactacagaagatcaggtgttttcttttgccctaatttaggaagagagaaatatttgtagttggaatttgaaaggccaaagtaataattacattaaatcttaattcattaaataaaactactagagatagagaggtgtttatttccaggccagtccagtgacctctaactgctttacagactccaacagttcccgagaaaggcagttaaattcagtgactatttactgaccatctcttatgtattaaacaccatacacatgtccagaatggcacttcccactcagagaatgcctttggtctctctcattcgaatttattatgacctcttcatacagaacgtttccaacagctaagctactctgaaaaataaacagttcatatgctaatagctggtaatgacaatgaactcccccagctatttgtccattgcccttttcttttcttgttaatctttctttttttttttaattttgaatctttgttctcttattcataaaagttccaagagaatggagtacttgtcttttccattgttgtatcctcagcatctaagacaatgtctggtatcgaaggtgctaactaaatacctctggatgactgggacacaggaagcagtctctcctacaggaaatacctcctggccagaagtatgggagactggaatgctcatccccacttggacatttgctaactatacaaaccagcaaggaaatcattttccctaagcctcagtttatgcattgataaaatggggctaattataaaataaagttcaaaataagggttctagagccaaaacacctaagttctatccaagttctactactaactgtccatgtgtgaccttagccaacttgaacctctgcgtctcagttttctcatttttaaaatgggaaaaatattagtaatctacctcataggattgttgtgatgactacatatttttttcaaagaagtatatgtcaaggtgcctggtacataaaaaatgctcaataaatatgacccacttctattatcagcattattgtgagaaatcaatgagatgtcatgaatgaaagtacttttactgtataaaaagctacacagataaatatttccagatttccatgttaccctgtcaaggacaaacatttgtcttctagcaggaggcttctagaaccacattgcttttaatcgaatttatagatataataaagatccttccaaatgatgggatagtgataaaggcagattttacaaaggaggagcttttggttgaccataacataacacttcaaaaattagccatttactctgcctaaagaggaaacaaaacaatgatttttggcccaattgtccttgttatgaaaattctttttgtttttttttgagacagagtgtcactctgtcacccaggctggagtgcagtagcgtgatctcagctcactgcaagctctgcctgccaggttcacgccattctcccgcctcagcctctcagcctcccgagtagctgaaactacaggcgcccaccaccacgtccagctaatttttttgtatttttagtagagacggggtttcactgtgttagccgggatggtcttgatctcctgacctcgtgatccgcccgcctttgcctcccaaagtgctgggattacaggcgtgaaccaccgtgcccggcctgaaaactttttagaaggattaaaaatatgtcacaaagaggcaaatttattaaaggaagccactgatttgctgacatgtattcgaaaagcagccaggaaaccgcagcccttttccttatcaaaaaaaaattaagagaaaaataaaagctttttatttacttgtgttacactggaaatatactcactagaatttcaaatattagtactgcacccaccatacagtgcttgcttaacaaaagtagacattacattagtggaaattgaagtgtagtaatagttttatccacaaagagtaaggcagagctatttgaaaatgatagaaatctgaaattggatatttaaatgtgggaaaatgaaggtgtctaaaagcatgtgaaagtattctaaccatattttcatcctgttgcatattaaaatagaaaatacacaatagctgtgtgatttaaatgatatatacttgatatgaaaaaatgtaaaggagaaggttgcatacagaagaaatcatccaaaattcaaaatactagaaggttttatttgttaaagcccaggttaatacaaacaaatttgtaaagtaagtacagtgagaaatcttctttgtaaagttttctttatatttgaacctagcaaaaggtctttctggctataattttacctttctagtatggctatatttttcagtatggaagatttttctaaataatctgaatgaggggtgtgatttgaatctgtatcatgttctatgcccacctcccatcttgggatattgagatgctcaaaaagtttgcagatgttattttattcctggaagttgtactaataagtgatagccattcctatggtacctaggaaatgagataaattctttaccattgtttcagactattatgttcaaacagccactgaaatataatagaaaaatacttaattacttagagaagctaaagagtgatttggcaaggtcagagttttaaaatggagaaataagcaaataaaattctttttaatgctagttaattatttggtcagttggtaagaggaagtaaaagtgaagttatcacggaaaatgttgtccaaggaaggtttatatagttgtttagttgggtgttttcatttttcgtgtgtgttttagtgggccaggcaaaaggtcaccccagtagaccacatagtagctgtttttatcaggatagctccattttacctctcctcctgcaaactgcagtaaaaatagaatatgaaataatgtattagttccctaggatggccaaaactaagtaccacagattgggtggcttagcacaacaaaaatctactttccttaagttctagaagctggaagtctaaaatcaatgtgtctgcagtgtctctgggtagcatccttccttgtctctttctagcttcaccaatcctcattattccttgtctttcaggtgcataactctagtttctcactctgttgtcacatggtgtttttcccatatgttttttttcccccgatgttttcttgttacatagccaccagtcatattggattacagctcaccctaatgacctcatcttaatgcaattatatttttaataacactatttccaagtaaagtaatatataatatatgactatatataaatggctatatatatatgactatatatgactatatgactatatatatatatatatatatatatatatatatatatatatatatataggtagaaggggttaggacttcaatttatcttttggggagacacaattcaacctataaaggcttagggtaagggagaattccttgaaacataattttctagagtagtaatcattttagatctctttagatctctgggaattatagggatacactagtaaatttcctagctagagtaaataattaaaagattctccagtggggtgggggtcaggggatggaaagaaagtgccttatacctctagtgggttttcaagtatcaccaagggaagaggatatgtaataggaatattgagaggcatcagtgaagttgttaaggacaaaaactcaagagccaaaaggctggttcacaccctgctccaccacttctagctatgtgaactgtggcacattatttggtgactccacacctcattttcttcatgtaaaatggacatgataacactacaaggcagctgtaagtattaaatgagcaaatacagcacctagaataatactttgtatggtgaggcatagatttaaaatgtttgaaaaacagtgaattggagtaagttactaatgaataccctttggtgattgaaaagacagaggaggaaaaaaaatacaaaaccgtgacttcatgcaagggctagatatttgaaactgttattgcagagaaaatacaaacaagggagcttcagattccaaaaggaagatcaggtgttaggagaatactagagttggttaaatgctacctgataattgtctagtgtgtgaccttcatggtctttacccaggtagttgtatttctttaaacttttattacattatagctttgtacctcctctttattgggtgggatttttttccagtgggattagtgcctaaggggaaataacacgtctctctttgggtttgaccttgcaaaaatttaattaagtgacagtaattatcaggctgttattaactttgaaacatctaaggcttgcatgctaccctagagggtttgtctgagtttagttttcacatattcagaaatattctttttaaactcacatatacagttgtgcttgtgtgtgtgtgtgtatgtttaaatttacatgctgtcaaaaatagattttgactgaacagtttcaatttggtcttatacaaatttgttgagtgtcccctccgcctccacctcctggatggatctggatctccgaggagctaaagctggtctctggaactacattatgtaaaaatctgtcccaactacagtcatttgtctctgggtctttggactgagatgtggtctcctgtgggtaagccacctaggttgctatccatggtgctgaatctcccctacacaggagcaggggtggatctttctctaaagtgtccacattcctgtaacagcctcataccatgtttcccctgagaccaattatagcttaattctcatatttctaatgactttctgacaaatacctacatttcttttctataaacttttactaaaatttcaaaacatcaaaacctgtagtgtttttgaacatgatctttgactccagcaaggactagtcaaatatcagatccaccatatgactctggaaatccatgtaactaccattagcttctgttttttcatcaataaggtgtgaataatgatagtattgttgggataatgtatgttaagaatttaatacattgccctagcccatagcagtgtgcctaatcagcatcactaaatttagctattatttctcattacacattttctaagaccaaagtccattttataatacaatgatgaaaaaagttacttagagtgtttatttgtacctcatttttcgaaagttggaaattattttattaacttaaataagaattatttgctcaatcttgggattcaaaatgagaaagagatagttcaaatatattttttctagcatcccattgctggtctagagtggtcttataggtaaagtaatcaccaggtatataaatacagactagctccaaattctacacatccagccatctgatatttggatcagtaacatctacattcagcagtaacacttaactacatacatgaataatatgacatgttaattttttcaaacttactgtatatatggctttgtccagttcttatttgtggttttattaaagatttgcctctacttttttttggaaacaatatttatattttatctctactatgtgattgttactttcgtttagctgcacagggcaaggcacttgaaaaaactggagatttaaagttctctagactcctttcttgatttagcatattagtttcatctggagagtttaagtattcatgagaaggtgggttccaagaactagaaagacataaggggtgagctccatgtgagaaggtgagctgaggtcaggattagttatatgtaaagatgcataagaaatggctaatcagtgtgcaagagactcataactgcccttgttacctcactggtttctaatatgactgtttaagccttcttaagtgttctgaaattattatatatttttaagacaaaaatgctcatttttactattgccaagtgttgaataaatatgtgtaatcactccccaaaatgccaagcatagtaataaatcgggtgacataatgaaaattttacttcctaatttgaaaaggagcctcaaaatgatggagcattcatgtgctaaaaacctatgatttataagccaataatattgtatgaattcagaggaccccagaaggctttatactgaaggtaattgtcttatatacactgcttgacatccaaaatttcactttatctgttgcattctgtcttcattaaaatgctatcacccctggagtggtcatactgtaagctattgctctttcattttagttttattaaaagttatttgtattcattttataataaattagaaacacttttgctactactatttcttccctatactacctgttacctgtcttagtgaatttgctatctcttgtacaggtctattacccagaatagatggcttagtaagttgatgcctttataacaaacaattcagagggacaaaagcttcttataagtaccacatgctaaccaattgcaccactggagccacaaaaaaaaggcttcttatttactactttgttcatgtaaaactacataatgcactttatagtcaacaataatgaggttgttttcatcatcctcctcctttacacttgcatggaaaatttgtcattctcatcaaatgatttcatcaggaatataatgctcatttattttgatcatatgcttattaatgacacagagaaagagatgctattacaaagtggtgaatagcttgtcccatctcatacacacaaacacacacacactcactcactcacctaaaagtagcaggtagttggaaagctttggtttcactggaatagtatcttaatttaatattctagcctacacagcttgaatgatcttcttccttcctactgctccaatctttatcaccttgcttctccagtatgttaccgttataccagttgcttcacatccctagaagccaagctggttcctgcttcagaaaccttacccttgatctggaatgctctcatcacagatctgcacattgctaattcttcctcatcacttatatctgagctcaaaagtcttcctaattcaaggtttaccttacccctggtactctgaatcccacaaccctgaaagctctgtaaaagtgaaatatttgtctattctgtttaccactggatccttagtctagaacatacaaagcatacgataggtgtccaagacatattttctgaatacaataatgaattataaaatacaaaagtgaaataataatcaattataatatgcccaaagatatctagtaccttgaagggataaggaagaaataagctataataattattgtcacttactgaacacctacaataatcaaggtattatacctcttacctcatttaatactaacacgaactttgtaccacagcactaataaatagccaagagaaaatttaacccatgtctatcctattacaaagccatgtaattagacattgggcacaaatattggaagaagcccagaatatttacactgagagacccaaatacagatttacctactagcacttttctatttggatgttggaaatagctatttgtgcatgaataattttctcaggatttgtatcatttaggattttgttggcagtggcagaagctgccacctaaacttacttgagcaaaaatataaaataagtaaatgtattggcccacagagttgaacagatgggaaggatggcttcaaagggggctcaacatggtcctcaaatcatgtcaccagaacccaggttctctcttgattttcatacttcacttccttggtgttaatatggcaggatgttagttctagcagctgcagggattatatattcctttatgtcagtgggaaggaggaagtttgcttccccagtagtaaagactactgccagcccacatggcacttttgtgcaaattgcaaaaggtaaccctttctcgaggaaatttccaaagttagtttatgattaatttatcaataattattgaaacttatataagctactctacaaaattatacaaatcatactgttagaagtaatatagtagaatatgtaaatttttaagattcaagtacactcatattagatgttacgtaaaaatttcatgtctttttttcaggaaaacaaattatgatactttaaaagcttacttgtaccaataaccaaaccatagacttcaccactttttctagtaggaatggagatcttaagtagtttttgtttaatttttagaagcaaaggtctcggcttctcaattaccagtatcagctaagtcaagtataccctaaatatttttaaataaaagtgtttgtaattttttctggtgaattattgccatgaatatttcagtacttcaacaagagatgttctaaatctaagaaaactatgtataagttttagttcctcatgttcctgatgttcccccagtatcacatgactatattccttggtaaatttccaatttatagtttatattgttgaagtagttcatattcatattcattacaacttttcaaattataattcatataaacactatcataaacttgaatcttaaaggtgatatatgttaatgataaatatagtgaaaaaagaaattcattttaaaatttagttctggataatttctatgatcaatataatcatgctgtttatatttgaaataatcatgctgtttatatttgaaatgagtctaatattttctattctggagaagccaatgttaatgctaaaagatagtgaaatttatttagtttcaattgtgtggtttttaaaatattgcttcatttttattcagagaatttttttttagtgctgtcaagtgtttacgtatgctaaattttggttgcttattatattagtccattttcatgctgctgataaagacacacccgagcctgggcaatttaaaaagaaagaggtttaattggacttacagttccacatggctggggaggcctcacaatcatggtggaaggcaaggaggatcaaatcacaacttacatggatggtggcaggcaaaaagagagcttgtgcagggagactcccatttttaaaactgtcagatctcatgagacccattcactatcaagagaacagcacaggagagacctactccccactgccatgattcaatcgtgtcccactgggtccctcccataaaacgtgggaattatgggagctacaagatgagatttgggtggggacacagagccaaaccatatcattctgcccctggcctctctcaaatttcatcaaaaccaatcatgccttcccaacagtctccgaaagtgtcaattcatttcagcatttactcaaaagtccatagtccaaagtcttatctgagacaagccaactcccttccacctatgaacctgtaaaatcaaaaacaaggtagttacttcctagatacaatgggggtacaggcattggataaatacaaccatccaaatgggagaaattggccaaaacaaaggggctacaagccccatacaaatccaaaatccagcagggcagtcaaatcttaaagctccaaaatgatctcctttgactccatgtctcacattcaggtcacactgatgcaagaggtgggttcccatggtcttgggcagcttcacccctgtggcttcacagaatacagcctcccttctggctgctttcagaaactgttgttgagtgtctgtgggtttttcaggtgcagggtgcaagctgttggtggatctgccattctggggtctggaggacggtggccctcttctcacagctccactaggagtgccccactagggactctgtgtggagctgtgaccctacatttcccttccacactaccctagcagaggttctccatgaggggcatgcccctgcagcaaacttctgcctaggcatccaggcatttccatacatctgaaatgtagatggaggttcccaaaccccagttattgacttctgtgccctgacaggctcaacaccgtgtggaagctgccaaggcttgcagcttccaccctctgaagccatgacctgagttctacgttgacccctttcagccatggctggagcagctgtgatgcacggcatcaagtccctaggctgcacacagcacggggatcctgggcccagcccaccagaaccactttttcctcctaggccttcgggcctgtgataggaggggctgccctggagacatttttctcattgtcttgaggattaacctttggctcctcattacttatgcaaaattctccagcaggcttggatttctccccagaaaatgggattttcttttctatcacattgacagactgtaaattttctgaacttttatgctttgctttccttataaatctgaatgcctttaatggcacccaagtcacctcttgaaggctttgctgcttagaaattttttccaccagataccctaaaccatctctctcaggttcaaagttccacaaatctctagctcagggacaaaatgtcactagtctctttgctaaaacataggaagaatcatctttacttcagttcccaacaagttcttcatctccatctgataccacctcattctggactttattgtccatatcactatgagcattttgggaaaagccattcagcaagtctctaggaagttccaaactttcccacattttcctgtcttattctgaaacctctaaactgttccaacctctgcctgttacccagtttgaaagtctcttccacattttcaggtatcttttcatcagcaccccactcatggtaacaatttattgtattagtccattttcatgctgctgatgaagacatacctgagactaggtaatttacaaaagaaagaggtttaatttgacttacagttccacatggctggggaagcctcacaattatggtggaagagaaaaacgagcaagtcatatcttacatgggtggtggcaggcaaaaaagagagcttgtgcagggagactccgatttttaaagtcgtcagatctcatgagacccatacactatcatgagaaaagaatgggaaagacttgatcccatgaataatcatttcccacatggtcctcccacaacacatgggaaatatgggagctacaagatgagatttgggcggggacacaaagccaaaccatatttctcatcatgttgcttataacattaatgttgcttaaaacattataccaaattaacagtaaacaattacatttgaaagcaaatagttttgaaagtgtaacattgtcttgcattctaaaacctatctatttaaactccttacttcaaatcatgggctattttttgtcgtcctagatgctagataggtgcagtcttgattcttaaacttgtctatcccatgtccaagcataatgatctgcatataccttgtaaaagaacagtctttactttcatctgtttgaaaattgtccaaatgtgctgattttcttagaacaagatatttaagcatcatctacccccgcaaagttgttcaaataaatatggaaaccatgtatgctggagttgacaaagttctgataaaataagaaaaaagtcaaaataatgaagatgtatcaatatgaattgtatcccctcagatgtattatctttctgcagtgtacacctggacaatggtatgcacctctcctgaaaagagtacagaaaataaaagccctaatcctcactctctttggccctaactggatggacttgtgttgtttgcctaaatcaatcactattactggaacttgaattattctgatggcccttgcctcactctcaggccctggagttaaagtcaatttccatagaagctagaagtggagaaatgtgtgttttaattttattttaagaagtgggtatgaatattagcctgcagatatcaaatatcccttacatgtttgattataaaaataagtagaactgtaaaaaggaatccttttttttcaacattaatccaagaaacaattttcatgccattattctgcctaaaggtaaatatctaagtatacccttgaataggattaagatggctcccatcgttcttgtttatttggctaggctttaggattttgttcagttagtgtttggttgttgtttttcctatggtagtctatgaaaaatctttaggaggaaactaccctttgtattgaacacctggtccaattaggtagcgatagttgacctgtgaatgcataggtaagtgtactttttcaaaaattaaattcgtattggaacacctgttcctgtccatagagttaattgtatgttcagaactgagctttatttggagacttattcataaagggaattaatatctgccactttgctacagagttacagcaaagtcatgccaccaacacataatcattcctgtcacttcctcagttccctacacacagattctcctgctattaatgttccacagattgttgtcaaatatacatcattagataagataaaaatgattgacaaatttttcttttgatgggattgctttttgacaaagtatcactatatagtacacatatttgtgtgtctacacatacgcaatatcatgatttgtgatggctactagtcaatgaataagtcgccttttcactgatactagtgctttatttgtaagtgcatttagcaagtgcttttatatatgaaatcttaaacattctttttacatgtataacctgtggtgagagatgctcagcccagcttccccatcttaatgaaacaggaggagcttcaggacgaaaaagatcataaattatgtttaaaggaattttcaggtccatagtttgagaaagttagctaaagattgacttaccatagttattcttcggtcataagatatttatacacatattgatatattcttataaatattatatataatattaatatttatcactatataacattgaataagagaaaaagaaaatatattaagaaaatcatcaactagacacaaaataaagactttcttctctgttaaagagaacttcaataagtaaaggctcatggaatattctcctgtggaaatcatgaagaaacagaggccccaaccatttttctaagaaaggttagctcttctcttcctggaagagagaatgccaattcacatgcccttttccagtcccactgagcaattagattttatgctttctgactggatatggacaaaagaggaaagttatagaattttccaattatatcaattccacagaaaacttgtccgagacatgcttagttaccaagtacatgcttgattctgtcatgttcagttgttggtgtggaaggacatcatgtcctctcagcttgctttgggaatggccgttctacctccattaagttgtgcatggaaagtgttaatggctttgctggggcgcggaaatagttttggaattgagctaatggtgtatttccccaccttcacaccctaaaaattctcctaaagatacattactcggttcactttattcctcctatgccatatgtgcctagctttaaaaatcaaaaatgtcactaaagttccttatatagttctttatatagacttttgactatcctagaatctgacaaatcaaatcattttaatgaagcacagcaaacatctcatgttgaaacagctgtaagcacactatgcaaattgtgtttactagtagcttatgctccagagaaataatctttatatgactgctttattatttacagtagttttgaaatttaatttttgtcaacattgacagatgccttccatgttaatacttgggctgctatatatggaaaaggctaaacatatgcagagatttcatgtttgtgaactgataatgtggttgacaaatgggtttaacaatatccagtcatttctgggcagtcgatgaaattcacctgaggtctgtgaagaggaaggtcagaggaatatgaatgaagaaagaagaaagcagtggctctggagggccctgcatataatgaaagcatgacagagggtgattaattatatttcagagccagataattcccagagaatatgtgtgcatgataaaaagtttctaacctttccagttgtaattaaatgagggattcactggcctaagctgagtaaaggctgttttgttccataactgtacgaatgcacataatgaaatagtttatttcaaatgtgcattttttactgcctgagttgtgaagttgacaaaactggataatacccagggggtgaggaggaggttcagtccactggggaggactccctcccttagaaatgaactggttaaataaatttagaatggcttggaaaatttacctgtcctaaaatatctgaggatataccctcaggtaaaaaaaggaaatagaagtaattcttaaccaatacagtttcatgtagctttagatttaaatcttctgcagaataatgtgtttataatgttgttcgggcttttcataatgttctgccttttaggtgctaacttgcagtggtccgggctttttctctcttttttcttggcatctcctttcagacaaaggaaagtaatgggtccagaaaacataataaaaaccttttagtttttatgagctggtttgagtgaattctgaattcattagattccaatttttataacaaatatttattgaccactttgtacatgcctgatgctatactaggtaccaggggattcatgccagacatacaacagtgtctgccacatagtaggtctcaatgaataggtgttgaatgagttggtgaagttgaactgtgtgttaatatttgaattcagtggatttggttacttcttggtctacttttctaatatatgaagaaaaagtagagacagcataatgaataaatatttctaaagtgttttggttaatgacaaaaatagcccaatgcctccattatttctgactctatttttttcaatgcaatgaattgcattcattcatttttttgatagcagtatatgagtgactcagaagcaacttaatatttagaatagctggtacaggataagacaaaaagtaagtcaaactaaatacatattaattgaagggtcaataatttggcaatgagttgtggaagggaatggtaattgagtattaggaaaaagagttccaatgcgtcatttaaaagattgttgttttctggatataatgatggatattatgtgtttataggtcctgcctttccgaagattttacagagacccctttcttcaagtgaaaggttatcaactgttggtagtatgctgcattaacagacaactcctatctcagtcacttgccacaaccaagttgccacaaccatcttacttaggccatatgtcagctgtagcttttctccatgttgccttccttcctaaatctaaggctaaagaaccaactttcatatagaacattgccagccactgcaacagaaggtaaagagacctggtgagctatgggctggctcttaaaatgcctataaggaagtgacacacaacacttccacccacatcccattggtcaaagaaagtgaaatcattgaaaactccctgcaggctaaagtgtgctctgttttgcctcctgtcaggtcccctgtacctatcatggtccctggaatatgccagatgcttaataattattgattacaggaccagctacatcattcacaggcccagtgctaaatgaaaatgggatgactttattcaaaaagtaggggggaaagtacaattaaagttactcaaattaaaacttcattctttcttctgtagtctctctctcttctggatctgtcgaggtggtttttatatttgctgtttttatttattatttaatgttgtacttgtccaggttttagagacacttgctgatgagtacagatgtgaacaagtgcctgggagcctgtaaattatccttcccacagccttgaaatccaacgctttgcaatgtgtttggtaccaaacacatcagaatcaggggtggccaagtcgtctgccaaactcactgtggtgctgccagctggggacagggcagctgtctattaaaattctataattttaatagaattataatgttctgttagttttatagtacatgtgttgccaaccagtttgtcagtaagatagaaatttacatacatgtacagacattcacacactgagactgatttagctctctggtgatgaaaccaccaataccaaggcaaattgtgcccttctaatggtgacacacctcggctcaagggatgggatgcaccatatgcttctccctctcctggctatcaaggatggcctctttgatgattgagttttatggaaaatatttgaatatccttgaagtcattatatgcagaaattggaaggccctaaatctaaaggagggtaatatgttagacagacatttattaatagaatcatagatccttcaggtataagggatctttaaagtcgccaagcttgaatgtctttctgctgaggaatggaaacccacagaaatgacaaagcttaggttgcactgcagtgcattcctacagtcttgaccagaatccagctctcctgaccgtccatcaaatcttaaattgttttgatttcttgttatgtttttcttcttctttgagtgtttaaattactttgtttccagtctttattacaagtgatagaagaggataaatctcttatactgtttgagaaagttaagttacatgaaaacatgaaacctagttctttccttatgattacttaaaagattttaaagtaatctggtctaagtaggcttatttacctgaaaaataattgaatttaaaccctctgaatcatgtcctcttcaataaaaaagcactgtgtaatatacctactaataaaagaaatagatcccaatagttaaattcataactagaaacagaattcataacactaataaacatccattttttttaaaattaccttaatgcagataactcagaagtcagcattttatttagaaatgattctttctctttctcctctgctgtcctcagcaaatatattcctttcacaatgtacttgaggtatcttgggtcctatttggcatattaagactataatttggttcaccttaaggacataaaagagatagttataaaaatatttaatcccacaaagagatttgatccttggatattacttctacactagtagaatacagttcagtgtgtgtgatgtttaaagctaaaatttgaattacttcaaacaaaatagagaacagtcacaaccaaggataatgtgagtgagaaatacaaatctctagaacagcgattctcaaccaggggctattttgcccccttccttcatcattcccccaccccagggacatttgacaatagcagagacatggttgtcatgactgatgcttggttgggggtggcagggaagaggcttactggcatctagtgggtagaagccagggatgcatcctacattacacagagcaatcctcatccccagcgaataattattgagtccaaaatatcaatactgcaaagttgagaaaccctgcccgaatggcttattgctcaagttttgtccaatgttgtcacatggatacgcattgctgttgtttgccattgttaccacttaggactttgactaagttaaattcattcttggctttgtcctttaggtaaaatcactttttcatgtccccatcccaaaatgaattcatcatgctcaaaatggattgagaaataaatgtttttctttaaagtttaaaatacatgttttcatattagaagcattaaatcctttactccagtttagtattccaaagatggggaaaactaagccatggtttgaatctactttatcatactgagctatttaaattcttcattatcatagaaataattagttattttcatagtaacactagaatgcttgatagctttgataaagcaagtgatgagaatacgactaaaacagtgtttctcctaaaatgataattttacctgaatattttatgtgcagtttgagtaaatatacagtatgtttacatatatatggatatatataatatttacatttaaccttattcaccatttgaggtgagggtagaatatactacttatcaaaccccttttcttttcccggtaaaatccaagtcgattgagagatggtgtatgttttaaaaatgaagattaaaataacattttggctttcttactggtaaagcagtttgagaacaaggctttggtttgtggccacaacctggcttccttgtatcttcccctccaagttgaatggatgcaggggtgtgttctgagtcttcatgctttcagatatactcatcatcattgccctgctctgctctgggcaaggagaggctgcccactgcagactgtactttccaggctcttgtgccagctggatctagccaatgggcttcactgatgggagacgggaaggtactgggaaaggagactcaggggtgtttttccctctctgtcatgttatctgcagcaagcctatctcctccttggttcccgatcctggcagaaaggcctgtcatgatcccaccttctactgttggactctggtacttagtcccagtaaacttacctgcctgggctctccctgtgacccagggccagaggtggctccctgttactgctaatacccatctcttctttggcttcaaagctcttctgtcacctctgtagccagtttcctgatgaaaaccatgttccaaagattcttcttattctcatctcaaactctagattgtgaaacaaggcaggaatttgagaaagcatgcaccctgagaataggctgcaccccagagggagccaaagcagtgctcctgcttacctccttctcccctggtctgcagtcagatagactccctcttcccaatgggacaaagagagaaggtgctaaggaggcgctgggcatggtctagccctaatatctcctccagcagaacagagtagacgtttccacttttcatatacattgggggccacacagactatattacagaatgggcttcaaggctggactgtcagggttgaaatcgctgatctacctcttgccaactgtgttatgtcaagtcaattactctgtctttacttgagtatctttttctctcgaataggggataaatatggcctgcttcctgggattattatgaggtggatgtagtctaatatacaaaagcaatgagagcattgcctggcacatgggaaaccctctgtaacattagctgctattattattacccctcttggtcatgcccataaaatggggataatcatagcccctacttcaatagcttagttgtaagatttaataagcctgtgtgccatagtaaaggctcaataaattagctgttagtatggccatctcctctggggtgtctttaattaatatttcctttgatgttggagagaaagaaagagggaagttaataaataaatgaaattgtaaatatgtaagaaccaagtactcaagacctttctttttcagctttggcttttctaagagtcatttggtgaaaatggcatataataataaaacaagtctgaaatttaaaatgctagggcttttcaggaagctgcatgctgtgtgctgcgtgcttgctaagtatttggctaacaggaagccatcattgatctcccattctcttttcctgaccatgtccttctctccctaccttcatccatccccatcacctcctcccaccttgctttctaagttttattagctctgtcagcccacttcagtctccatctggactttgaagcaatgaaaaccacaggaggacaatagtctgccattttaaaggaaacagccaactgaaatctccaaggtttcctgaaaaggcccaaaatatgaataatcactttcttctctcttccattaatatcattcataaaagatatatttccaccttaaaagaagttcccatgcatttcagcgctatccattcccaaagacagagtttttttcccacagctgcatgtacactaaaattgtgccaaaaccttactgtgcaatttataaatacaaaagaattttacatacttaaattttaaaccaaactaggcctaatggcagaggaggctaatttcctaatttcctgggcctggggccataagctaaaattacatatacaagtacaaattttctctgatcttatattatagatatctttaaagaaagcatacatattttgcttcaagctccataattattttgacataaaaatagtattttaacatactcattaaattatttaaagctcaatccttaagtaaaattaatgcttctataagatttgctgggtttgtgcccttgacgttttattcctctcaaaatcatctatacccttaggaagacacatacttcactcaaggaagccggagagtcaagtatgttacttaattctcacaatcctaagacgtcattgcagttgtatccactttattaggagacccagttttggagaagttacatgtcttgcccaaccaagtttagacacgtgttaaaagtctttctctgtggccaggcacagtggctcatatctgtaattccagcactttgggaggccaaggagggagaattgcctgagcccaggagttggctgctataaggtcccttaaagatggtaatagtcaggggccgggcgctcatgcctgtaatcccagcattttgggaggccgaggcaggtggattacttgagctcaggacttcaagaccagcctggccaacatggtgaaaccccatttctactaaaaatacaaaaattagctgggcatggtggtgcatgcctgtaatcccagctactcaggaggctgagacagaagaatctcttgaaccttggaggcagaggttgcagtgagcgaagatcacaccactgcactccagcctgggggacagagcaagactctgtctcaaaaaagaaaaagtatttctctgagtaccaggacactcccagtacagcacacaatatccctacccccaggaaaatcaggaccagttgtggtcaataatcataatcacaattgctgaaaagcggtgccatggcttatcttaaaagatgttttgaaaaataaatcttacataaaatgctaatgtgattttgccatatatcatcttacctcaaacactggctttggtatgaccagggctgtctgccctagacccaggcgaactaaacatattccagggagaacactacctcctccagctgaaatgaatcaggatttatgcagccacctgtacaatacattagctgccacctgcagacctacccagctgtaaacaattcactgaaatgaatagattcacgtggccagaactagagaacaggttgaggagtcaggaaagaggagccaacacaaatgtaaaggaaagctgaaggggaattagaaaccaaaccaaaccaaataaaacattgagtttttcgaggaaaggaagcaacagcatctgagttaactacaggtcagtgattgacaattctctgcccaaaaggttttgaacggactgtcctcgtatgtgtaactctgtaatttcagccttcaaaattatgatttttcaaggctaaaatgtgcatggtagttttaagctgaaaggggaggaggaagaatagccaacagtcagatagtgaaccaaatgatacaaatattgtatattcctttaacctgtgagattcattagaattcatttcttgaaaaataattctctgaagcagcatgacatgaggcagtgttaccaaatgctagcaatggacagatttactatgaaacatatggaactttagccttggagtcctcacttgtacacgagttttatgttgtgttccacgttgggagggcaagccagatagcaatcaggaataatctgtctatgtgtctctggtaaagtgcctgaggaaataccagaagaagggcacctatgtctccaagactccaggaattgttgcatttctttcttcattctccgtaaataccaactttcccactttattttgtatttttcttaaagagcctccaccatctccaaattgtagtatatgctttcgattttccaaagcccagatttcttcctggcagtgctgggccatgacaaagcttttgccagaccaaaatgaattaaggaaaataaggataatatagactttttttcataaagctaaattaatattcactacagtttgtggattgtgtttgtttttgatatttttctatgccttgttgataaatatagccttgttgataaatatagccttgttgataaatatactttcttttaaaaaccatggccatagatgttagatgctaattttaaatgtttatatatacacatcttctcataatacaaaatatgtttgaaaattctatgtcaggacagccaaaaagccccgaagcatactaggaacacacttgtagtcaataaatgttgaatttcttgcttgtaacagagagggagggagcacaccttggaagtgcaaggagtcacagaaggtgtgtggggaaggatttgttgtaggatttggcttgtgacataatttggagaggtttcatggttttgccctgaattgaatgctcacaagtatttggttggtgcaaaagtaattgcatttgttgccattacgaaacacaaaggtcacataattagtatttgggaggctaagaattaaacctaaatcatgtgtcctccccccattaaaatggcaaaactgcaattacttttgcaccaacttgtagaaataattctagattggatatcttatttttataagtaggtaggacaaacgaagtggagctaaagcagtaattagcaaagaaataacggtcactttttaggcaggaaagggatgatttgttctgttttgtagtttggctcatgtctgtgttatggtctatgctcagacgtggttagaaagttgtctcattttgccagtcttcatcacagtcacagagtggccttgtctaatgtgggtgggtattctatgaaattgtttgtattcagcagaagggcatcatggtctactgccagatctgctccacactgacaccagtcaagagtgtgtctgtctctctctcttcaatttattcacaaaaatcacagaagtttggaaatcattgcaatagaagaagtagtctgaactagagtgcctgtttgtcccttactagttgtgtgaccctagaagaaatatttaacagcaccaaggcatcagtgtcaccatttgtagaagattaagctgaacacatatctttccctgtagagcgacgtggttgggagcccgagttaagagccacatcatctgggtttaattcttagccccccaaatactaattatgtgacctttgtgctagttattcaatctctttctcatctgtaaactaagggtgaatagtatctacatttcagagtgttgtgatgattgaattaggcaacatatgtggagattttagagtagagcctggcatgagataaatgctcagtgcatgtttgtatctactatcatgatagtgattatgcttatcactctattaattttgcaactattatagtctatgttctggctatgttacataggcatatcaaataacttctttttacttaggtctcattttctataaaatcaagagtaaacttaggaacaaactagaaaattcccctctaggagctgaaatgactgtgggctttgaggtaaatcagttaagattttaagacccatagttgtgttaatcataatagctggcacgtattaaattcttcataagcttattcagttcccataactctgtaagaatcccagaggctcttctaagccccctttttaagtgagaaagctaggatttgagagaggttaaataatctgcccaatgacgtgtatcttgctagtgataaatctgagactggaacccagatcccaaattcacaatcactgctttgtgattgggaagctgttacacaagggactcattacagggcagcaggtgtaaacactttttgatcttagctatttataaataaacttgaaatagaatacattagaatgtctgagaattcaaacaaatggcaatttaaaggaaatattaggacttcttggaattcactgtgctcctaagtcccaaatgttgtttccctaaagctacgtattttcttatttttacttgacaaacaaggaattaacattttcagactgatagaaaatgctggatttcctttttactgatactattattgaacaaaaccaacttttgacatgttccttgtgtcacatatttgaaactcaaatgtgtcttcagttgttttaaatgactgtttactgcagcctctggtttgtgtcattgacaattatctttggaaattaagcctggaaagggaggaactgtgacagaataagcaccattgggaaattgctgggttcactggtcatatctgtgcctcattggtatttcccatttaagatatcatatgttcacatcagtcttggaacatgttgacctgagagtttgcttgcaattcaccccttctgctgtcctgcaaaatcctgcattgtccatgctgtctgttagccattgtgttatcagaatctatgtggccatttcattatcagaatttgatatttgaaagaatacatacatttttcaccataaaataaaaagaattatcatggcagaaggaaagaaaatcagaatttgaaaagcccttattatcaggtagacacaatagcacacttatctctcaatattatctcatttcagcctcatggctctgagaaataagaaatattatctcctttgaaaagataaataaataggggctgagagatgttatgtgacaaacccaaaaccacaaaacagagtttggacatctttaaatagagagttccaaattctagattatagattagattgctgaaatggtttggctgtgtccccacccaaatctcattttgaattgtagctcccgtaattccaagttgttatgggagggacccagtgggaagtaattaaatcatgggggtggttctttcctgtgctattctagtgatagtgaataagtcttacaagatatgatgttttataaggggagttcccctgcacaaactctcatgcctgccaccatgtaagacatgtcttgcttccccttcaccttccatcatgattgtgaggcctccccagccatgtggaactgtgagttcattaaacctctttcctttataaattgtcagtctcaggtatgtctttattagcatcatgagagcagaatattgcaaaatttatctctttctcagatgtatttggatattaaccgggagactatttcagaaatttgaggcctatcatttacagttctagcagagttttgtaaaaatgtatttgtaagaaatacatttttacaaaaacttgaaagtaaaatggttgtataactgaggggatacaacatgagtgaagtatgggctttgatgttagaccaatctgggttcaagtactagatcaccacttgctagcagcatgaaactggtcaaaatatgaaacatctctaagcttcaattcttttatcagtaaaattgagctaacaatattaacttcttaggcttgctgagaagattagatgggtcaattcatataaatccttggctcagtgctgggcacaaagtgagtactcaacaaagggcattagttggggtattactgcccagtgcacagttcagtatcatttattcataatcaattaacatgcataaaaatctccaacatctcatggatgctgagtttttattaatgaaggcttttcaaatggattatatcatttaaagcatgacatagagctgccttacttcactattagtctccataatgaaaaagatatggacccaggtggtctacaaaccagacactctccaaacccttgagttcttactgtagcattttatggtatggagaaaattttaatggaggcatctgggtattgagactactaattgattacatgcgtgttaacttttttttaatatggtaccttcaagggcatatctgttgttcagcctggttaacgtcggcctgtgaatctgttggtataaaaacatgttacattttgacactggctaggatctaggatctcatttttctcattttgcaaaactggaaagccagcctcatattttatattttctacatgcctggttttcatgaatcagctggttggtgatcaactgggattttgtgctgctctcacaaatacattccccagtgcctggcttgggctgtgtggagtgttgaaattaccaatttcataaaattgcttttgatgttgggtaagatgctatttttattgaacacagcaattgccgtcccagtttcagaaggacagtctcttcttcttgatgatcctatttagtttcagatttgtgtttggggaaagtagttattacacagttttgaagccccttcagctaaaattgctggggaaaatgtctgctgggccgggaagctagtctaagcatttcagctgttttctgagagatgttaacaaacatttcaaccttggtggattatcacaatttgcctacagcattttccagggatttgcataaactagcaggctaacgtgaggcatagatgtgttacctattcatttttattatgcagtttattttggaattctctttgcctgagtatcaactcacaagtggcacttatttctgtatactctttatttttttattcattttaaaaaataaactctttatatataataaatatgtatatggccttgcatctctgaagagcagaaacagatgaacttgaactagaaattagagcttaatggtaggaaacaatgatatggaagctaagaagaaaggtgactagtggtaaaccaagaggagtgatttaaaaaatgttatgaaataaaaatcaaataggaaggcaaaaacaaaatggcatcatggttccaagccatgtacaaaattgaaaaaaaagtaaccccatgatgttactaagcactgtgattctatctgtgcccttatctctcccaagcctccttagagaagtaaacagtcttgcttgtggccacttttttgtttttttttttttgggacagagtctcactccgtcacccaacctccgcctcccgggttcaagcaattcttttgcctcagcctcctgagtagctgggattacaggtgtgcacaaccatgcctggctgcctttttttttttttttttttttttgtatttttagtagagacggggtttcaccacgttagtcaggctggcctcgaactactgacctcgtgatccacctgccttggcctcccaaagtgctgggattacagatgtgagccacagcgcccagccacttgtgaccactcttaatgttaaatgtatcattttggtgcctatgtttccaaagactgcccctcaaggataatctgtgccagcatatctattcagttccagttctgtcatgggataagtctttactcagtgtggtgatggttaatgacatgttagagattggcttcgaagttcagaggccacagttcttgactatcagatcctttttgctctcaaacaagactcttgtgaatttgttgttttgctttgttttaatgcccacagtctcatatgttgaccattggctttctacaagctcaaggaacacatcttcaatactagctgctggttaaccttacactttggaagagttttacatgtataaagttggaaacaggagagacagaggcagcctgtggctgtgtatgaataatctctgacctatcatgtttatgaagaaattctgtgctgagagatagagaaatgggagggttttcataccttattaatttagaattatataaaaattaattcacctggttctgggttaaattttgcattagtcttggttttttaagttaaaaatgaccaaaccccaagtcaagctggcaaaataaatacataagtacatgcatacacattggatacacacataaactgaagtactcttgtgtgtccaattgcagggatagctgggtccaggggctcagagaatgttaatagatatgtgactgtgtatcagtaccacttatatatgtgtgttggcctaattcttacagaaactggctttgtccatgtatcatgggcaaatggtcaaaagaagctacaggttacgtcgtcatagttctagatgcaaagaagtctttctcttccaggcttcttctaagaaacctcacttcagattctggttcagtttgggttgcatgccctttcctgaaaccatcaatctggccatgtgattgaggcctctattaaccaagctgatccaggtgcttattactgcaactggagagtaaggctggcttcatcaaaccacataaatggattacttactgtgtggattatttcaataacaaagtcacacagggggatctggagagctataccaggtccccttcatatgtttttactttgtcttaagtcttattttgctttgaaatgcacataatagaaatgacaatttattgagttcttgctgtgctttatgtgtgttatcacacttaatccccaaaacaaccctgggatgcaaggtatgttatcaatattcacaatttacaagggaagaaatcaaagcttagagaaattaagttgccttgggtcacataactagtaggtggtagaactgggattggaatcagatataataaactactaagcttcatgactgtgttttattcatttatttggtttgtataattttggaagtttttagctttgagatatttacctgaaagactgccttaatggtcttagtctatctggctgtgacattttctactctcaataaatatttgtattgcccttactagatttaaataccttgaagacagggaatttcatatgtgtttttttttcacagtttaaaaatagttccatacctaaaagaattgaaaataggtgttcaaacaaaaatttttacagaatgttcacagcagcacaattcacaatagctaaaaggtgaaacaaaaaacaacaaatgtccatcagctgatgaagtataaccaaaatgtggtatatccattcaatgaaatattattcaatcttaaaaatattaagtactagtacatgctataacatggaagaacctaaaattcatgatgctaactgaaagaagctaaacacaaaggtcacatattgtatgattctatttatattaaatatcttgaatgagcaaatctattgaagcaggaagtaaataaatggttgctagggttatggggagacaggaatggagactgacttcttgaagggtacaagttctccttttggcctgaagaaaatgttctcaaactagatagtggtgatggttttgcatcactgtgaatgtactaaatgccactaaatttcattttatatgatgaattttatattgtatagttcaggcatatagtagatacttgaaaaatatttaataaatgaatgaatgctagtaagataatagactttttaaaaaataaataagttggttactaggactctaccattacaaagatgtttattgtaaagatttgaagccaaaatcaggcaccttttaggaggttattacaaaatttgtgtgacttgcatagaatcacaaaaagactctgaatagctaaagcaatcttgagcaagaacaacagatatcacacttcctgattgcaaattatattacagagctacaggtgtaaaacagatacacagaccaatggaacagaacagaaaggacagaagtaaacccattcatatatggtaaattaattgtcaataaaggcaccaagaatgaacaatgggtaaaggatagtcttttcttttctttttttttttttttttttttttttgagacggagtctcgctctttcgcccaggctggagtgcagtggcgcgatctcagctcactgcaagctctgcctcccgggttcacgccattctcctgcctcagcctcccgagtagctgggactacaggtgcccgccaccgcaccctgccaattttttgtgttgttagtagagatggggtttcaccgtgttaacccggatggtctcgatctcctgacctcgtgatccgcccgcctcggcctcccaaagtgctgagattacaggtgtgagccaccgcgcccggccaaggatagtcttttcaataaatggtgttaggaagctgcatatctgtatacaaaaagaaaacagaaaaaaaaaagaaattggatccatacatagaaatcaattccaaatggattaaagatctaaatgtaacatctgaaaccataaaactcctaggagaaaatatagtagaaaatcttcacggcatttgttttgacaataattttttggccaaaagcacaggcaaaaaaataaaaagcaaaaataaataattagattacatcaaactaaaaagttattgcacagcaaagaaaacagtcaacaaaatgaaaggcaacctgaagaatgagagaaaatatttgcaaaccatgtattggacaaggagttaatattcaaaatataagaaactcatgcaactcaacagcaaaaacaaaattttttaaataaaaattgggcaaaggacctgaatagacattgtcctaaagaagacatgcatattaaatgaaggagaccaacaggtatgtggaaaggtactcaacatcactcatcatggatataaatcaaaatcactgtgatatcacctcacacctcttagaatggctgttatcaaaaagtcaaaagataataagtgttgatgagaatatggagaaactcttgaacactgtaggtgggaatgtaaattggtagagccattatggaaaacagtggaagttcctcaagaaattaaaaatagaacacacagccaataaccatatgaaaatgtgttcaacattgctaatcatttagagaaatgtaaatcaaaaccacaattaaataacatttcacaccaatcaaaatagctattcctaaaaagtcaaaaaataacagatgctggtgaggttgcagagaaaagagaacacctatacactgctggtagaaatataaattagtttagccactgtggaaagcagtttgacaatttctgaaagaacttaaaacagaattatcgttagactcagaaatcctattcttgggtatatacttaaaggaatataaatcattctgtcataaaagcacatacatgtgtatgtttttcacatcaccattaataggaaaatcatggaatcaacctaaatgaccatcagtaaacttgataaagaaaatgcaaatatacaccatggaatactactgcacgtagtgagatgatatcctttgcagcaatgtggatgaaggtagagacctttatcttaagcaaactaacacagaaacagaaaaccaaatattacatgttctcataagtaggagctaaacacagtacatatgaacacaagggaacatcagacaaagggacctacttgagtgtagagggtgggtggagggtgatcaaaaaactattgggtactatgcttactacctgggtgatgaaataatctgtacaccaaacccctgcgacacaaaatctacctatataaaaaacctgcacatgtacccctgaacctaaaataacagttttttaaaaaatagaactaacatgtaatctaacaatcccatttgtggttgtataaccaaaggaaacgaaatcagtgagtgaaagagagatctgcactcccatgttcattgcagcattattcacaatagccaagatacagagtcaccacaagtgttcattaatgaatgaatgaagaaatggcatattattcagccttacaaaagaaggaaattctgccatcaattacaacatggatgaacctggaggatgttattataatgaaataagccatccacagcaagacaaatattgtgtgatttcacttacgtgtggaatctaaagaagtcaaactcatagaaacaagtaagactgtggttaccaggatttcaggaggtgggagaaatggggagatcttggtctaagggtacaaaactttcagttataagatgaaaaagttcaggaggcccaatgtgcaacatggaaactatagttaatatactgtatatttgaaatttgccaagagagtaaatggtaagcttatgacacacataaaataatgctatgaggtgatgaacatgctaatcagcttgattgtggtaatgattttactatgcatttatacatagaaaaaatggtatgggtagggccatttatacatgttttcctttcttcattcttcaagataggaacagagaacattcattctattaggcatagttcaaagcagtgctgagatactatatttcttttgttgttgttgttgttgttacatttgtcgatttgtgaaacagcttttgaacatgttgaagaaaatgctaggagtttatgaacagtagggaaagctagatctttcaaatatatctacattggacagttacttaagcaatgtataagtcaggatagactctcagtgtgtctcaatcttaatacaaatcatgtggtgatgttgttaatatgcagcctctgactcactagttctgaggcatgccctaagattctgcatttttaacaatctctgaactgataccagtgctgcttgatcaggtaccacattttgatttttgctgtggtaggaaattcaccctgaaatcccagcgttttgacactcgtgctatatgtctcactcatgttacatgtctgaggcaagtcattgagacacattgatatgggttcctcagggacccatatcaatgaaggatctatcatcttgctgtttgttgtatcttctgagggataggaagagagagggttggaaaacagagccccagcaattaaatacttgactccaaggtgtcacacatcacttatatcacatttcattagccagtagtagtcacgagagcatacctaacttcaagggaataaagaaatgtaattctgtgtatattctgaagcagagcagaaccatagattagtgaaccttagtaacttgtcaaggtgattgtgcatggagttttatcatgtgaccataatggtcattcacaagcttcatgagaaatgtgtttgcattatggcttttgttacatgccttttatttataagagcgtttggtatgatttttctttctcttcataggataagctaataattcttttagactgatagaatttgcagctgaaaggaattatagatgttatcaccaacgcttttatttagtaaatggagagtcagaggcataaaaaatgataagcactttgctttccagggatgagaatatcatgtctattatttagttatttgggcttcaactctgagtctttctatggtaccactgcccatttttccctctgggaaatagcaatgaatgagttatccatacagagatcaacttttccatactcatgattatacacatgatcttacatagaactttatactcctttaagttttaaaatagttggattaaaatgggtttcagatgcttaataactcaaatttccaggccattccaatggtttatggaaacagtgggacaaatttttttttaattggagaggatatcctataaaatataaggcatgtttttatacacatatacgtaatggtatcagacacatataatcatatcccaactttggtaggttgagttcgcttttaagaatttccattaattataaaaattactggataaataatggatgatagcaatagctagaatgaacacccagttgccgctgaattatgtgctcaagtaaaaatgcccttagaaaagaagaaaatctcacgatattactggtgacatagaagatttacttatggaaaactttcctttgttgctttgtcaagttgtcatttgtacaccttctttgtggttcccagatcccagcacactcctttcaacatttgttctatacatctcttccaccttaatatactgagttggaaaagtggcaggttattaagaaagaggcgagccttggagcctggcaaacctgggcttgaagcccagcaccacacttttgccagctgtgtggtgttaggtaaaacacttcctctctctgatcattggctttctaatttgacaataaagaacataatgtctaccttgtctagttgttgtggggattagatgcaatatatgtaaaaggcacctagcagaggggtcctctcattgcatgcattccttaaatgctgactatgattattttaaagccacgggaactgggcttcagtatctgaaaatcttaattctgacatcctttcctcagtgactttgatctctaattttcatgcttttgggatcctcctaactgacttttctgatactacttacctctgatgtgcttttatcatgaaaaagctaggctcaagaattatctatatcttatttttaaagaaaatccagaaatctgaatatctatgtgaaatttcctcttctccaccatcagatctgtgagaaaacacatctttggccaagagccaaagtttgtgactttctattaagcgtagtttaatattccccaaagtataatcttcaaactatctgcttgaaaggtatgaggatgaaaaggaaagttacaattatcattgtaggctattaaatcagaatatctggggtctgggcaggatatgcattttaaacaagctttccaggtgattctatgtcctttaatgtttgattatttatttatttattgagatggagttttgatctgtcaccaggctggagtgctgtggcacgatctcagctcagtgcatcctctgtctcccagattcaagcaattctcctgcctcagcctcccaaatagctgggattacaggcatgcactaccatgcctagctaattttcttatttttagaagagatggggtttcaccatcttgtccaggctggtctcaaactcctgacctcggtaatccgcccaccttggcctcccaaagtgctgggattacaggcgtgagccaccgtgcccggcctaatgtttgacaatttagattagttggagtattacccccttttccaggcttattgagatatagttggtgtattagtctgttctcacacttctttatagaaagaactacctgaggctggataatgtatttttaaaaagtggtttaattggctcacggttccacacactatacaggaaacatggctggggtgccctccgaaaacttacaatcatggcgaaggcagacgggaagcagcaagtcctatgtggctggagcaggaggaagagagagaatggggcagggggagcgggggtggtgccacacatttaaacaatcatatctcatgagacctcacttactgtcacgagtagaacaagggggaaatcctcccccatgatccaatcacctcccaccaggccctacctccaacactggggattacaactggacatgagatttgggcaaggacacaaatccaaacgatatcaattggtgtacaaaaaagttgctttggtatacaaaactgcacataattgatgcatactatttggtgagtttggacacatgtatatactcatgttatcaccaaaattcaggtaataaacatacccatcacctgcaaaagcttcctgtgtccctgtgttattctgttttttgttttgtgtatatttatggtaagaacacttactagaagatctaccctcttaaatgtttaagtactgcatttcttaaagtaaccttgaaacggtatcaggaagacacagggatggggcacattgtggcttctgagggaaaccctaggtatgtgaagtgaggtacacatccacctaaacttcacattcttttccatttgccgatcttctctcttccagctgaaaaaagagcagtgtggcatgcctgagacattgagtccccaaccaatttcattaattcactgaagaccacatggttgaattttctgatcacttagtgggtttctgtcaaattagattagctggtgttcaagtgcaaagcttaaggttctttgggttggagttcgtttaaagatgtgggtatttgtttttgcagtacaaggttgtgttgaaaactcttctccctgatgagctctggactacctgctatggatctttcatgcctgttgttaacaacacttggatgaggccatgctttaatttttacttatgtaatggaactcatccatcacattttacagagcctttttgatacggtcagtgcttatcggtgttcaaaaaataaatccctgttccaaacctgtatttaattccaaagcaattgcctttggctatgttctacagtcagtactgaatacgttgccttgtaggtggttttgttttattagtggtttctgagtttaaacaaaaatatgctttgtttgtcttctagatttcagttagtattcatgcctctgttaacagtgaatgttcgataaatgctatctaataaaaataacacagatatcattttttgagcttttattatgtgccatattctgtgttgaaccctttataatgaagcattttgtgttaaggattctcaattcatccttaccagaaacttgtgaatattgttgtcctctttttatagatggcaaagcaggctagaggggtttgaaattattgagccaggattcaaaactttgctttcttattccaaacctgtatacaaggttgatttacataaactatcatgaagaaagtttttaataatttccactttagcctaacatctggtaactgtattaatcagttattgctaccatactgctgtataacaagttaaactaaaactcactgccttgagacatttgttgtttgcttatgggttggtgagttgtctggagcttgatctaagcaaggcttggattcgtgctgtagattggattcaagtacaggccaagtttttccttctgaggctcaggctaaagggcagcatcttcctagggcatagtcgtctcatggtcaataacaagaagacaagagaaacatgtaatacctctcaagaatatggactagaacaggcatactgtcaatttcacctacattaaattagctaaagcaagtcgcatggccaaaaccaatatcagtgtgatgagaagtgtggaaattagtgtggatgctgagagcagggtaggtatgtaaagaaccgcagcagtgcttacatccaccatagtcacccttccttttcttctcatgctcactgaaatgtcattggtttctgagtgtggcattaaaagaactgaatttttctacaaattaaaacaagattttacttttatgtctcattaaagttataatttcagaacatttttgctatgttaatcataaagatacagagacttgtatgattagagacatgggctcagtagagattgtgattactgtttataaatgattatggcaatatggatagtaatagccaacccaatttgagagagaaagacaaagttaaggttcatttattttttgaagacattatattaatatatactacatgagaaacagaggcaatctgtgtattgaaaaagtttattaaaagctcttttgatgctttatttggtagagctgtgacttacaatccttttgttctagatagaactacatttttgcagtgtgtacaactctacttaaacattgccagtgtttttgaatatgctgttgccacttttgtccttaatgtagatttttgaggaaagaaaacatcactaagatattgcaatcttttttccccacctctttgcaaactatgactaggccagcctctaatcagtggtatgctggtaaaccatctctaaaagagaggggtggaggggctatgatttgtactgttcaccgatttgtaaggtgtaaatattcccaccatggctgctttggatttgccaatggcttaacaatcagctcacaaaatgcagctatgagacagctcccacaaccatcttctgatacgaatactatttgttccaccaaggagtttcctatcctttttattttcttctaattattttttcatactgcctcagtttgttctcatacaccatcaaaacaataaattaagcttaagtgattctcaaaaactagtatgaaaatatggtgctttaaactttgaaaacaagccactgtgtttttgacatacatgcaaattgagtattctactgtagaagacagcacagaatcctaaaagatcacagcctatcatttgttacctgttcctcaaggtataagaaaagaaactaaggttctctttgaatttaaatagccaaggtttcagtggaccaaaaggcatctccttccctgccttctgattccatctgaaataagctacatgaaatccatataactaaactttgtggttgcattggagaatgtacttaacaggatcatatgtcaatatgtcatgtgaatggaatgactttaaatgtagaaggcatttgaatggtagaaatagtctctcctttgcgaagtattatgcgaaggaatgagactgggtaaaatttcctttaaatagactcaccatcgcactctactccttagcaactgacctctccccctggagttgagtgatgggcacatattctgtgtattttcctctcccatttttttttctatggatatttccttgaacaggaaagctcaatcatttctagcctaggcacattagattcttggagggatttccaggagtaagtacacatccatccttttctctaattaattcaagtactgagcattgatagggtcacatgccctgtcttacatgttgggatggatacaaaactaaatttgattttttttaagttacaatttaatgaggaagacagaaatctgacctgtattcacatttccttaatctcaggcaaaattgaagggcaaattgagatctgtgctatgaattcagataaaagaaaacagacttacagtggagacgttgagagtaagggaagccttcctggaagagatagcattaaatcgtgggtaagatgttgatgtctaaaagttaggaaagagtgagctagttttccagaataagagaataaccacccaatgggttcaccttgcccactacctagacagagctgatgtatcaagacaggagaattgcaatggacagagtaattcacacagaggtggctgtgtgggagaccatagttttattaatactcaaatcagtctctccaagcattccagtattggagtttttaaggataatttggtggttaggggctcaagaagtagggagtactggttggtcgggttggagatggaatcaaagggggtcgaagtgagtttttcttgctgtcttcttttcataggtgggatcgcagaactggttaagccagacagcctgtctgggtggtgtcagctggtgcacccagtgcagggtctgcaaaatatctcaaacactgatcttaggttttacaatagtgatgttattcccacgagcaatttggggaggttcaaactcttgcagctagaggctgcatggctcctaaaccataatttctaattttgtagttaatttgttagtcgtacaaaggcagactggtccccaggaaagaagggtgtttttttctggggggaaaagggctattaccaattttgttgcagaattttcagagttcaactataaactactttccttctcaaggttagttcagcctccgcccaggaatgaacaaagacagctccaaggttagcagaaaatggagtttgttaggtctgatctctttcactgtcataatttcctgagttataatttttgcaaagttggtttcaggaggagtcaccgaagtaaaggttagagatagaggaccacagagtataaaccaagagatctcagttattcagtttggctggagcttgatagggaaaattgggagatgtggaatgaaagtttagcctgaaaaggccttgagtaccaaggtggttttggaactagtggcattttgagttggtggttgaatgaaggcacgtttgaagaatgggatcttgctgaagaaactgcatcatcaaatggttaccatcttccccttaaagctagttgagctatgaatgggtggaaggcttccacccttttgaccaattctgaaagctgggtggcctccctagaaatgatcactgactctggcaaaaataagataaagggaataaactcacaaaacaaagatacccctgtcctccaaagcctccataatgtatcagccccatgtgagatccaaaccagtttggaagtaaatgtaagaaagtactagaaaatctaagatttgccatcttgatgcagaacaacaaagtgcttgtccagttggcttttgtttctcttgtctcatcctgcttagaactgatgagcttctggggagtttctttaatcagctccgaaaggctgtgaacttgtttattcccatatcagtgcagcaagatggagtcagttaaatttagcttaaacattaagtaccattcaaatacgtctttctcttaactatacaaatcctgcagaaaataagattttcatgtcttaattgtgatacctaaagtgtcttttattctcagcatgcttgagatagcaaagtaattttcgagctgaatgtgattgtctcagacagtcatgattcaaatatttaatctaaagggaaaattcccagagtgcctctctcgtcatttctcagttctatggagaataaaagcctcaactttatatgatcagatattatttccattattggtattatgctgtaggcaaatatccttcaagaggcaaagtctacatcccttgtgcttagcgagttaggcgtcacaaaggcccaatctggcctttacaatatgagctgctgctaccttgtaatctgtggagaatttaataactataattttactttatacagcacagcctttaagatttaatagtagattcttcacacacacaaagtatatttttctcttgtaaggccttttcttattcaaagatcaaatttcctataggtttagttgctttaacaaagtgcctgtcaggttgcactttgtaggggtgggtgaggatctatagattgattacctggggaattggatgaaagcaactttcttagcaacccactggcatcatttcaagttttctcattacccattaagaagcaaatgtcctaggttaattgtcttttctaaattgctggcattttaatgtatcccaaataaataatgttacatctcaagcagtttttctccaagtataagtcttcagaccacccatgtataaatctcctggtgagattaaaaatgcagatttctgaggtacccttaatcttactgagtcagaatttctggggataggaccggtagtttacatttttaaaaagagaataatatgtgattcttatgtacactaaagtttgagacatactggtctctgtgctttgaaatttcactatttaattttattcttacaaatgttatgtatgatagtagtctcttcagacttgtaggtaaagataataaagtacagattggcttaagtatggggttctcaaattccatgctgaggtacccatggatactacagtgatctcacagaggtttgcaggatattttaaaatttctgggaaaatacagtgatacttgagatctgttgggcagctactagttcaaggcagttcaggttcaaactatatctctgttgcacttgttgccacatattttttttatgttgtcctgtttgtgtagccgggtttgtagttcttgctgtgaacaaaagcttgacccatatgaaaatcaatatagaacaagaaaaaagaatgctgctgtccaatctgattctgacatttaagaagtgtgcagcaatattattatcaatttttgagatggagttttgctcctgttgcccaggccagagtgatatgtcatgatctcggctcaccgcaacctctgcctcctgggttcaagcgattcttctgcctcagcctcccgagtagctgggattacaggcatgcgccaccacgcctggttaattttgtatttttagtagagacagggtttctccatgttgatcaggctgatcttgaactcctgatctcaggtgatctgcctgcctgggcctcccaaagtgctgggattacaggcgtgggccacaaaagattttattatatttttataatatttaatatattcacatatgtgacattttataatatctctcaaataatgtatattttttcaaacagatgttaaaacatcagaacataaacatctgttagggtgtttgaactacttaataaatggaaatattaagtgttttgggggcctactgtacacagtgaaaaactactgggacactaaggtaccacatgaccttactaaagtttgggaacctctagtttaagtcatgaatttgtggaagtaaattatgaacccaagtctacatggctctaaatgctatgtatgttgaatgatgcttcttagatcataatctcatcaaggaattccagagtacagacgtgtgtgatgacaggcttgggtgtgaaatgctgttcaggactgcatcattaacataggagttcattattctcattcttctaaagtggtcacattgaactgactatcaagtaacctcgattctagccctgacttttccccctagctttgtgactttgggtaggttacttctctgtgttttagggttttagctgggcttggctacctaacaacagagataaggaagaggatagttataaatatctacacagtctttagctgccaggcattgtgctaagtgctttgtgtcattgtttttattctcaaatatccttgagttattttattaggttcttttattatttctatttaatagataagcaaactgagaaatagagagtgaagctctctaccagccaactaacagctagcacagaatatccaacaccggaaattatgctcttaatcactgactacaaaagttataaataagtttattttagttctttacagtcttcaaaatagctacaatttaggtaacagagtgaggccctatctcaaaaaaaaaaaaaaattcaaggaaatctagtgcctcattcatatttagatctcaggagattggcatcatatggagtgtaacaaaatgtccaccttcacagtctacatcctggaagagatcaccattttgaaccagaccaactgtgaacctctggagataccctacttcctgccaaattcccacagattggtcaccaaagcaggaggtcacaatggactggaatgaaagtgagcaaccagggccagatctaatccttacctcgttcaggcagagaggcctagaagaagaaatcagaatcaaggaccagtgagtggctgctgtgtatttctcatctgtctgtagctatcatccttgcagcccttccttccataacagaatgcaatttccaaagaaaaccaatgaatatagaaatagagctgcccttttacacaggaaaatcctctgactcgaggaaaatagaaaaggggattaacagcactcagggtgtaagaagtcaggggaaaacgtgagaaatcagcaatccgttgatatgaacagtagagtgacatttaagctggccaaggagacccaggagatcatgttcaagcatttctttaaggcagagaaataccatctcattcaagtctttgctattgcctggaaaacaccttacagctagaaataataataataaataaaaaggcctttgcaaaaagtgttgtggagtaatgttggaatttgttttttaaatgaaggttttggaaaaccagaggtatcccattgagaatttataccatattttttgagatggggataggaaagggtggatgaaaagatatactgaggatacttggtaatgagatgcacattctcttttttagagataaagatagaaaagattggccggagagagaagcttgttaacttacaggcctgactctaccagcaaactaacagtctgcttagaatttttccagaaggaatggctggctacttcgcagctcttttttttacactgtttccttgggacctcactagctgcatgtggatcagatttgtctaattgagaagccaaaatatttagaagtactagagggatgggcagcctactcagatggaattaagttttgtgtgtgtgtttgttgttgtttttgtttgtttttgaaacagggttttactttgttacccaggctgtagtgcagtggcatgatcatggctcactgcagcctcaccctcctaagctcaggtgatcctcccacctcagcctctcttgagtagttgggactaccagtgtgcaccaccacacccagctaatttttgtatttttgtagagatagggtttcaccatgttgcccaggctggtctcaaactcctgggctcacgcaatccacccacctcagcctctcaaagtgctgacattacaggcaatcttgtgttaatattcaggagcagatgtgcttatctggcattttccttctctgggccccaaaatcttgaccattgtagtcataaagttctctaccagctcaaacattttaaagcaacagtatttgggagtgttctttaactcatggcctttatggtgacaacagaagcattgattgagaatgactgctaacatttttgaggctctatcatctgacaactgctgtacacagaacttgctgtaggttaactcctttaagtgacaaagcagacttcagaggcttcaagcgacaaagtaatttgcacaagtttaaattttctgtctagagttgttccatattcttcaataatgagatgtactggtgcttcccaacttctttttctgaaacaagacacaagaaacaaaatgttttagtatgctggggtgtattttacaagcaaatagcagaggctagagggctgatagaaacagtatcatgacatataacctaagtgacgcaaatgcccaagatcctaagatctttctatgagggaactagttccatcccttttctcagaaggttcttttgcattagtccagcctgttttctccactgtgatcccacatgtaggatcttgctttcatcttatgtcacctactctgggatgaccaattcttgaatcatggccgttattatacatcattttcatctggaattctcttactgcttatacttttgcagaaagtgtgatttttgctattgagtttctgaatgattttgcttctctttaacatactccgcaaatactagttgtctgctttaccagttcacagggatgccctgaatgatgttacaacacctcttccctctctctcttgctatccgctcccttgctttctcattctggatttaccaagactaggtattctccagggcaaaggcaagagttttaaattctgttattgtttgcaggaaacttcactttcctctcatccaagctggaaatggttctcctgtagtgcagcaccataacactttctgtataacatagttatttcctaatggatttatttatttatttcataatggatcagacagtacatattttaggttccacaggtcatatggtttctgttgcaactgtgcaactctgtcattgcaacatgaaagcagccatgggcagcataaaaatgaatgaccatggttgtgctccaaaagaactttatttacagtaacagatattagactgcatttggcccatagggccactgtgattccagctcagaaatcactagctttgcctttacttataaagagtagaggcaagaggttaccttttaatcatatcatatattctagcaacagtcaactacaatatgccttttggaagggtacatctttatttttatccttctctgcaacttgttcaggataatgtctctgagccatttttctcctattgggtcttttctcctactggattctttatctctctccatttgaaattcctggctgcaagggtttcaggtggggactagtgtggcattactgaaaggcaaccaaaatcagtgagacttagtgctagtcctgatgctgccatttactaactccctgatgttgattcctcagagccttttcataccttatctgtaaagcagacactcctcaaggggttattgaaaaggtaaaagtgccacccacgggagcttttgacttaggcccctacttcttgctagctgtgtcatctagagcaagttacttaactgctctatacctcagtgccattgcctgtaagatgaaatgagaccttgtaaaaattaaataacataatgtatgtaaaaatgctcactgcagagctttgcacacagttagtctatactaaccagtatttgtatttttatgtatcattatactcatttatcactatacttatggactgcttcataaattccaagccagagtacacagtcacatacaatgtctaaccttttcttctaccatcaaatatatttggccacttaaataaaagagcttatttcgtcttactcatatgctttcttgaactagaaatttcggtgatagaaaaccattgcaagctacctgagacctattttcctaattttgttcctgtagatacatttcagatgttagaggagggaacatttaagctgtaagatccaattcaggcatcctgtttctctctgagctattaattaaacttgactcctgaaacgccaataaattgcaaagggcttccaacttgctacagttctgtaatatttcaatcaaagtttctttatgatccttgttttcttcccacgctcctccaccccaagaacatctgaaagcaattttaaaaactcaacatgcaatgtaagaatgaattactgcaatcagtcaaagagatcacattagttcatgaaaagtagcatggttgaaaaactgcactaggaagatcaaggattcatattaaagagggggttggggcaaaagcaaaatgaatggcttttaataattttaaaacatggttgatacaaggtgtagaagctttttgcttctaaaacaaactggttttcttatgctaaaaccttgttacaaagctgatgccaatctcctgcttgtttctttataggagactgatttcttttttcctttctggaaatttctccagaatcattccctatggattcagaaaattctgctattttctaaggacatcataaaatttgagatcaattctcctaccagctctgttatcttgactatctcttttttcaggttttgggggggtttggcttggagcgtttaaatcagcatttaccatcttcaaattcaaagttatctgcacctacttttttcttcgttttcacaagcaaaatgctttctaattgctaaaaaatttgtaccagaaatcacagcacataagtccccatttttctggacatgatattctcttatgaaaaggtgttacggaaataaagatcccttagagactacagcaaagactaataaaggacgataaagtcctacggcacccatatagacaagaggaagagttaacagtcacagatgtttagttcttcagcatgtgtgttttatttgggcatagagtgtttttaaattttcagctggcattttaaaatttcataggaaaaaaagtcaagataagcagcaagttgtacctggaaagagccagatagtaactattttaggctttgaggcttacaggtttctatcacaaacacttaactctgccatcgtggggagaaagcaaccataagcaatatgcaaatgaatgggggtgtggctgtgtttcaataaaactttatttgtaaaagcaagcaggggatcaggtgtggccattaggtcttagattatgaacatctgatctagattatcaccttccctagtggggatgcggaagggagcccagaagatcagcatctctgggtccgtattcaccataatagccttgagccaattaacaacagttcttttttcacacagaagaactttatggtttgccacagtccccactactccctatgaactcccaacccagtttacttcagtcgttagcagtatttatctggcctctgtataatttagactctataactctgatttaagggttgtaaactgaaccgtgcatatgtatagttattgctataagtagcaaatgttatcttaaaaactctggtgggccaaagtgtggataacaagactgcagtaagaaagaaattggtactcagcgcctcaatcggctttgtttgatgaagcactgctttaagaggctgtgcatataatccctgctctagaagacctgagagtttaatgttctgcacaaatccaaagaaaagcaaaatgttgagtatgtgttatatacaatgagagacaaatgctgttcttatttaattatgttatgccagtatcttatacacgctgttcttatttaaatatcttctaataaataacagaacagagtttctcaaaggctggtccttggactttttgcagtagaatcatgagggatgggagggatacatgcttatagttagattagaactacagatacctaggcctaccacagatttcctgaattagccttctaggatctgcatttttaaaaagtcccaaggtatttcttatacactataaaattgcagaattgctcctataaaacaaggacaggtattgtacttcctgtttgtttattggatgtaatttaaattcctttttaacagaaaaacagcaggatacatcttcaggacagagtcaattacatgtacgaacatacattccagacacaattaagcattgatgaagaggttgtttatctgtgtcagaaagagctccatgctgggtctcctaataagtagtcgtgtggccgtggaccagccacttaactggtctggtctctatattctaatctgagggcagaaatgagggcattgctaaaagaccaagacccttgtagctgggaaactgactttgaaattccattaaagaattcctatgctgaagcatatggtactgtcttacttgattagtgagatggaaggacagtattccctcctaacaggtggcttacctgtattccagtagagtggggcttcccacctttggatgctcattggcatcatacagggagctttttaaattcctgatgtccaggccatgctccagatcaactgaatccaaatttctggtgctagaacccaggcatcagtattgttaaaattccttgggtgtttctaatgtgccacccaggtaagaacagcagcactagagcaatggtagccaaagttacttaattaaaagagtaacctgggttgcttgttgaaagtggaaggtctcagtcactgtcctgaacaatccaattcattgagcctaggataggttctggaaatctgtttttgatgagcaaccaagacgattgttggaatcagataaattggggtaaacaccacaccagagaatttcttagtgtattaagcagattcaatgcagtagaggggtttttcttcaacccccataggtttgtagttaaaatggacacctgttacaaaagatagattaacaagagaaaaataaaagtttattaacatgtgtattttatatattcatgggggacactcggagtagctctctaagagtgactttgaattccagcttatatagcatcttcaaaaaggaactatacatttttagagagttgacaagacaaaggaaaagaactttgagtctctaggggtagcaatttaagggagaagacaaataactggaagagaaaagctcttgtaatagacaagcttgttaatgtggattcctctggtatcatctccaggctgatgagggtgtaaagctgtcttcagtggttaactttgttctccccagcagagagggggaagtttacctttgtgtttgcaaagctctgtcttgtttttaggcaagcagagtgaggtcagagagctatcctacatctgtttcatcttaatggtcttcagctcaacagtcctatttgggattcctatttgggattcctatttgggggcagcaagttctattcttccacactggaaagcagtgtggaatgctctattaagagcattaaggaatagagatgtataatcgaaataagaatacacaattgtgggagattccaggaaagtaagggtctgaaggaggtgggagatctgagaaaagtcactaaccaccctcttgagcacttgtaggtaaacaagtaggagcttgcataggaatatgatatcagggaggaaatacagtttctcctcaagtcataaatttgtagctgggacagatccctgtaataaaagacagattaacaagagaaaacaagcaggtttattaacgcatgcagtacacatcatgcaggggaaacctcagtgaaaggtaattgaaggcaatggcttagaactctagctcctacagcatcttcaacaaaataacaataaattctagagaattgacaaggcaaagaaagtagttttaggcttccagaggtgaaaaactatggaaaggtaaatatatagaagtaaactaatggagtaaggtttgtttgtggattcctctggtgccatatctgagctgacaagagttttctccagtaaaggagaatttatattccatctgtctgtatagaaaagaagggaggacagaaagcattcttcctttgtttgctgctgcctagctgtctttagctcaataatatttatgtcagagagacctatttggcatgacatattctggtttctgtcagtaggaaggcagatgccactgccacagtgggatggcagaagaaaactgacagaagtgcatggaaggctgttgtcccattgtcagtgataggcctggggacactggtgattagagggtcaggagttgggaagaagacctggaagcaaagcaagggaaagtgaggatgacctagagcccacatctgtcatttacctcctctacctatgatgaccttcccagggtatagggctgcctttggagacttctgttctgaccaaatctaaaacagaatcaaaaagcgaagaagccaaattgacccagtattaaaccactatgccaggaaaatggcttttttgttctcctaaaattgggccttttaacaaatgagatgactcccttatctgtccttaaattgtgttcactggagaaaaaagcacacttcacagatttgttgctctccactgggctggaattaagtcattttatccccaactctgatttttcattcagttgtctcccaccagctttgtgtaactgatccaagcaccaagcactagtagtctttggtccatctttggacaaacaaggagtctgtagcttttgtttctttggttgtctctgttcctagaagtcacattgtgaagatggacttgattgtgtctctgtttcttaagtaaagcctgatatagcgtgtaagccatttataggtgattctcaccttatcggtttatgttcagctgcacaaggacatcatgtgattattgtggtgtgagcactctagtagtaatttttatttggtgggtttgagaagtttttgatgctttaatggaccgggtgtttctgagctaggtttgtggacaagtatatcattttgtattcatagccactatttgctatataatctggctgttcatgcaacaatggctgcagggaagtagggaacaatagaaggaaaactctaaatattcagaaaaaggcaggaaacagaaaaatcgagcctgaggcagacagcagaggagcaaggtcagtagggaaggaagaggaagcattcttgtcaaaggtcgcacagtatttcagtctcctaacgttttaacatgtgtgatgaactccgcaagcaaaatccaccaggcttgctttattccacgtatgggctaaaaaagagtaagctctattataattcccaaattaatcaaccccagtctgagcagtacaaaatggagtttttagacaaaatgctgcaactaattcatacaactttaagcaaattgtttttgatctctgggcctccgctttcccaccattaaatgtggtgcttggattggattagagattacatattagcagccagtgggttctccctgtatatatactaactgaccctcgagttttgactataggggttttcgttcattttttaaaacaaaacaaacaacaacaaaaactagactctacattttatttgaatttcatttatttttctaattttttttttctatcccaagatttaatgtaggataccacaatgcttttagtacagggtgatttcttttaatggaattgtcaacattcaaaaagtgaaatatttcacataaaagatgtggatttcacacttcctttgaaagctcaggtgatctgatgtggatttcacacttcccttgacagctcggagaacaaaagccctgtgtttccatctagcagtgataagctggagctgagatgctactgctcttttaggcatgacatgtgccttcattttccccaatctccgctactctctattgcctcccagacaatgagaccaactgacaaccgccattaccatcacttgttacctcctcttgctatacagtgaagagaatatgaaacatctagaaaaagaaattgagcaagaacaaatttaaggaaataaaaatacacttaaataactgacttagttcattcatgctactgtaacaaaatactttagactaggtaattaataaagaacaaatttatttctcacagtactggaggctagaaagtccaagatcaaggcaccaagagatttagtctctgctgagggctgctctctgttactcagatagtgccttgttgctgtgtcctccagaggggatgaatgctgcgtcttcacatgatgaaagggatggaagagataaacttgtcccctcaagcccttttataagccagacatccattcaagagggcagagcctttatgcctaattgcctcctaaaggcctcacctctcaatactgttgtattgggaattaagtttcagcatgagcttggaggggacgcaaacattcaaatcattataagcaatccacttcactcatttatatggtcgttcagatccctgtggaaattttggtgtgaaatttctggacaagagcaccttttccatttttttcactgtggacatatgggaagtggtgtttggtagccagaccagagttctgcaaaaaactgtgagggtcttgcagatggggtctatcatgctctcttcttcaaccctctcttactgagggtaagggttttgagccccagacactcagtcaacatagtcctacttttgggctcttttatttcctctaagtctgggcttgggaagccaggttgcagcacaattaagaatatgggctttgaattcaggctaccccatttcaaatggtagcttccccacttcagaggcatgtgacttctgttcagtcacttaacctccctttacctcagttcccttttcataaaattgggctaataaatagaactgagtcagtaggattgttacgatagataaatgcactaatatatgtgaagggcttagacaatacctggcatgtagtgagtgcttagtgcatactaatgattattactaccaccattatagcatcaccccagtgttttaaaaccccatagtagccttataaaaatcccccaatcccagactgcgtcataattgtgaacatggtaaagagcactaggggatacaatttcgtgaaattgattgagcatactttatgtagctccagggaaaaatacaggccaagtaagtaaaagttagagggaaacagatgttaatgcaacataaagaaggcttttcttatgttcaaagctagaaagcaatgaagtgactgcttgtaaggtgatgagcaacctgtcacttatggtgttcaggcaaagactgaatgattgtagctaggcaagttgtacggcaaactggtagtcacaaactacatatgactatttaaatttgttacttaaaattaaataattaagttcaaatcctagctaaaagaaataaatattttaaaaattgaaatgaaattagaaattcagctcctcaaatacagtagctacacttgaagtgctgatagcaatagccacaagtggctagcggctcctttattagacaacacaaatgtagaacatttccaccacaatagaaagttctgctgaacaccgtcattatagagggatgtcctgcactagatttctgaatccagtatttgggttggaataaaaaaacaatttgatatactgggtgatatagcacttacctgcagactccatgatttcaggcttatgcatggccccaggaaaagcactgtccctcagcctcagtttcctcatatatattatatgattaaaacttgtccctaagggtggttgtgagtataaagggataaagctcaagctcagcaggtagcacaaggcagcgtacacggatgcttgggttctttctttctatgaaaggaaaggaaacatgtagagtcaacaatctcaggtacagtaaaacagccattttatgtagcctcccaaagagcaagatctttccaaaatcaatagctaccctagctaccatcagtgagcacttaaccgtgtactgggctgtaagctaaactccttacatgcagtatctgatttaattcccgccaccatcctgtgagatggcttctcacaccaaagatcctaaaacttagagagattatatgatttcccaagattataaagggctgtatacagaattcaaatgcagcttcttttgactcacgatgattgctacttataaaaattgatatatatggaatattacatatccatacacacatacatacatgcatacatacatatattgtgctaaacacatgaatgcatcatctcatttaatccttataggtactatgtgggtgaagaagttttgaaaatttaaatgctttgcttaacaattcctacccagaaactagcacagctagtatctggacccaagtctctctagtatcacgtgttttacagctgtgttcccaggctagcatccttgtttagaagacaggtgaacaaaacctttaaggttgatgtcactatggcctttgtcatgcagagataaagatgccatgtatgtgttttctcttgccaatcacactgtaaactcttttagacaagggttgtatctccagcatttatttcttctaagtctccaagaactgcacagactacataggattcaataactatttgcctaattagaatagaagtaaatcttctcagaaaacagattgacaagaaatgtttcttatttagcaacttacttgagtggaaccttgtctatcttcatgaagaaaagcaagtattcattatgtatatatttgttatcactttaaccattgatggatgcctgcagttaaggtggaagggtctgtttgttttcagaaaaaaaaactaggattaatagcaaggcgaaaaacacttgatgtcaaatctctcagaaaaccaaataattttttggtttgatttgttagttttggctgccgtttaattccttaagaagctagggtaatagttgtgtactttcaggccatttccaccccttctattgtgaagatggagctccccacactagtcggtgtagtgtttctctgctaggccagccaagtagaaaactccaattagctgacaagtggttaaagtgctgctgagactagacacagggggagaaaatggctcttgtcaactatattctttccaagcattctgattcttgttatgttgtgcaaaaggcagcctaagggtggactgacagggcatttttatatcccttttagagatgtaagtgtccctgagcttggagattcccaattacacctgttcaagttcccaaggaattatgaggaagatgatctgttttagtttagatttgggatcttggaaattggagagataatttttctttaagaggtgatagaataatatcagattacagaagccttcagatgttacacaaaatgtttaaatgtactttacatgttgcttcatgtgccttcttgatattcttacaaaagtattatgtattcattaaatggattatcagcagattgttttggtagtattttcagggaaccaacattcaacaaggctgtttattcttattatagcaataaagctaaaagtcaaattctgctcccagaattactgaaaacaactaagtgtatgtattttcagacatttttctatgcttatatgactttctgtatacataattttgaattgtttttatttaaaacactgaatcattctagttctattgatttttattttttttatatcctggagatcttcatgtcatcttattgagctaataatatttacaattatacccagttttattattgatggcataccatatgtcaaattctgtactaagatatttacatctcattaacatttcaacaaatctgaggcattattccagttctatcattgttttcatctaacaggcagggaaactgaagcttgagaggtcaagcaacttgcccaagaaaaactagtaacaggtggactctctcagacactgtatgatatggcttccctttttaaatggttacatattatttcattgtttgcatgcctcattatccccacctccaaggtagactgattgtctttcccccataccgcaaatctatggtctactctccttccccatccctgcagctgctcacagccctcagatggagtttttgctggtgaataaatgctgcccttcctttaaaataaaacttgtagccttcaggatgacagagcctatggcatgtattagtgataccttgctggttcttaggtaaacatgtagcataatggagaagatgataatccttctatgaccatttttgtaaactgttgtcaccaattgagtgatctgaattgattttctgtttccagcctacctaagaagtttaatcccacctaaagcaataatcatccaacttgatttagaattaatcaggtatcatcttctgtcaaggctatggccaatctgccactttttgtcctgggtctcaccactataacaaaatgtcttttccttgcatgaatttgtttgacatcataagctttgtacccagagcactgttgtctactcttgggccagatatcatattatttatgctacccttctccatggagaaatttccttttttattgttcacatatcatactgcaaatacatgaagttcttccagtatgccctatggcaaaaggtcaatattcttaaaatcatgttaatcaaaaattgcagaacagacttcagtaatgcttgggttggccactgtgataggcagaataatgatcccgccaatgatacccccacaatccctagcacctatgaatatgttaccctacaaggcaaaaggaaaattaaggtggcagatagaattaagcctgctaattagttgattttaaaataaggagattatcctgaattatctagcttggcctaatacaaatacaaagggatgcagaagaaaagaatgcagtgatatgctgtgagaagaactcaatctgtcattactggatttgaagatcaaggaagggaggccattcaccatggaatgtgggcagtctctaaaagccagaaaattcaaggaaatgaattctccactagagcttccaggaaagatcacagccctcctgacaccttgagtttaacccagtgggaccgatgttaaacttctgaactacagagctgtaaaataataaattggtgttgtttcaggccaccaagattgtggtaagttgttaaaacagcaataggaaactaagccaccaaatgccccttcatggagctaaagtttatttcactgtcaaaacagagggctttttccattagacgaaccacttttctagttttataaggaagcatttcgtagaatctattagtgaggaccttgatatgagacatattgaataaaacatgtataaactgaacacaaaaatacaagtgtgctcccttataagatattatatgaagtggggtcatgggttcaccattctgttactgtatgttttttagacccccacttgtatttatcaggatcaatcaatgcctctccattatttgcagctatgattgaagtatggtacagattttccctcttgaacaataaaagtacataaccaactttgatggcacttcagttccatgcctcctcatgctaaatgtcgtggtgatttggcagagaatatttactccacagatcctcatagaggtgtgtgacgtgtagagaatagtttgactgcaccactattagcatcccttttgagcaaccatttgagcacatgcaagacttttatgattaacaatttaactatttagtagaatataggtgcttatcctctctaggctgtttgcctggttacagccataatataacatgttatacattgtggtattccagtacatatgttggcataactaagttttcatcatagagcaagatgccaaattcactcttcacccgatatttagagacaaaggaatgatgagtagaaggaaaagggcacaaagtagagtagcggctactcggtggttatgtcatttagtatggttgttgggttttttttaagtcacaaatctgctcactcagcagactgaaaatttcaagttggtaccattaatattgccacagttagtcatttgaaatactgtctgtacatgtaagtatgacacatgtttctatttaaactcacagcttggcctcctatgaagattcagcaatgctaaaatcactgagtcatatggaaatgctcacattttatgcagaaacaaaatcactgtactatacattagcattttgacaacataatgcagccatgaaaaaagtttggtactctaatgaaaactagaagttattaaaatcagttattattcattgaatattaagctggcgagaggcttttaaatcaccaagtttaatattcataagaaacacatgttatgatttcggtcttctgttttgacgatggataaagtgtggtatagttttatgctaaagaaataataaggcaaaatgcacttttgctgaaaactttaattactgtcatctaaaggatgacctcacactggccttcaagtattaaaataattattgtataggtgggaagtcagaatcaattggctgcatcacgaagtgttgagcaagaaaaaaaacagcattataaaaaagaatgaaattgtgtcatgcagcaacattgatggaactggaagtttttatgttaagtgaaaaaccgaacacagaaagatagatgccatatgttctcactcacaggtaggagctaaaaaaattgatctcatggagatagacaatagaatgatagatatcagaggctgagaaaggtgtgtgagtgagtagggttacagaaaaagggagggtggttagtgggtacaaacatagacaaaaaagcgccaatgttcgatagcagagtagggtgactatagttagcaacaatgcattgcatatttcaaagtagctacaagagaggacttgaagtgttatgggctcatagagatggtaaatactcaaagtaatggataaccccatattcctgatttgatcattacacattatagtcatgtaacaaatacatgtcccccctaagtgtgtaaaatattttgtatcactaaaaaaattaaaatggaaaacaaaggaaaaaaaaaacaagattaaactgtaacccaacagaactgggtaagacatgagaaagaaagcaaaggagagaacccacatttcatgagcatgtattatttgtaaccttttgtgttaggtgattttgcacattatttaatttacttgtgacacaaaaatctgtgagatttatcttatgcccattttacaggtggcactgaatctcttgagagggtaatgaatttacttgagctcacaaaggcagtgagttgcagagttgtgtaaatccaaaatcaatgatctttttactaacatggtgtcactcatctattaaccattccaaccagtccccaacttagcactaaataattttgaaaactaaaatggctgtctagtagagggagaaaatgtcttttacttctttctttcaatggagaatcaagcaataaggttgggttgggttttgttggtatggagtttataaattgaatttataaactatacctatgaatttataacatacctattatacactttctcaatgtacaaactgtgccatgctggtttctgaggaagatggaaacatgatttgtgctacaggcctagagggactgcaaggtgtgtattgggcacaagccataatcggagtctatactaaatgctgtgagagttaaaaggggatgtcattattcactttgctcctagagacttgcaaagcaataaccacagaggtggcattttggctgggctttgaatgataacattctcacggactgaagacggagaaatggtatcttagattcaggaaacagcacaggcaaaaactacagagaatcaagctataatgttgggtttggttttattggtatggtgtttatggacttgatttaatacatatctattggacaccttctcaacgtataagcttctgagctggtttgtgtttggtttgtttgccaaaaataaataaataacaggaggttaggttcctaacaggaatggagtggaaatgcagttcaacccttcctgcagtgaatgtgaagtcataaggagtttctaagaaggggctacgtaacagcaagctgtctgagggttttagaaggcagaaccaaaaatcagggagacaagtggttggtggatgatatcactcaccaggaaagagatgatacggtaggttctacaaatgtgtgtagttccaaacacattttactctgaaattaaatgtggggcatgtcatagtacataacgagtaatagaatgagaatataaacagttttaaagcaccttaatcccaaattagatttcttccttttttttttttttaacgatgtaagccctgtcttgcaggctttttttttttttttttttaaatacagtttaactgtcctgactttaaaattggttgaataaaacttttctctattttggatgatattgccaattacctactggggaattcctgatgttactctttccactagtttatgatttccactcaatccttggctcatgttattacaaagcctgagagctggttttggaatgcatgcctggcacatggtaggtgttcaacatttgttaatttgggaagagtgagaaggtagaaatattcgagctgggctcagtgaatgaatgagagcggcacacatgaaaatgagaaggaagtgactttgaggcagagaaaatgaaccacgatgggtcctgggttgcacctttctgtcctctgtgctaggacctgtgctaaatggcttacataaattattttatttagtctttggagcaaatcttatgaggtagagtgttcccacttgatagatgaaaacaccaatgttcaaagaggctgaatgacttttctaaggcctcccagctaatacatggaaaatgggaattcaaagtccgaaagacaagcttttgatctttagggtatcttgccctatccagagaaagcccaaggcattttttaattcttctaacccttttctgagaaaatacaatttgaaggaagcataaataagaaaaacttttgcaattttaaaaatgcatcctgcctgattttctttagaagactcatcccggttctttttaaagaagtaaatcattatgcattggctcattttcttgcctggaataaccaatgaaatctcccaatatatccaaaaagaaaggcaagttatagcttttttctttatgagtacgcaaactgaagacacaggcagccttgcgggatttctcaaggttacaacattgcgaacataagtttttacccattaccttactctgcagtgtctcaggggtcacattgtctctgtcttgttcaacatgccatgaaaaactgtttccagctgatggatttggtggcttgaaagcatgagctactagaggttaggaatctcagaaatgaagattgcacagtgtgtttgagagtaattgttcacaggaaaaaagctgagaaatttaccctctggggctgggaggagtgacaacagaaagtgaaatcagaattaagtgtaagtgaaggccttgttgctatctcccacctcagctttaagtcagcacttaggacagaaggatatagctctcagaatatcctgtaatatttgtttaaaatacagatccctggacttcaatccagacttgctgagttagggcttcccagggacaggccagataactgggcacttaccaggtacttttggtgattcgtcacaggaaactttagaaaactacgattaatggcagttattatttacactccatagcttggatactgtgtttgattcaggaggcacatctccaaaattccaaaaaagaagttaaaaaatgataaagaacagcaccgtaaagagagatttggtacaaaaacttaattaaagagggtaaagataataaagagaaggatgcatttcaaggggaacatttctagaggaacgtatttatcttataaacttacagacatctaagtttaaaatgtataaacatgaaagtttctagggaaactgagatgtatatctaagaaaagcatagactatatattcttcaattctgttttttcattgtaaatttggggtgaagttaactgaaataattaacataactaacattgaaatactccttcatatgtgccaggcagaattctaagaactttccatatgttaactcttctgttaacttctgaatctttccaacaaccctatgatatgaatattatttttatcctcattttataaatgaagaaactgaggcacagagaagttcagtcccttatcaaaggtcacacagtcagaaagtggcaaggcagggatttgaacctaaacatgtgtttgcagaatctccactgcatcctttatttaaggtgataatcggcttgtctgtaagggaccttatgattttgaccttgatcatgaagctgaaagactcgtttattggagtggggcacagtttgttatattaatagtagttgtgtttgttgtagcagttcatatacactaagcaagcaatgtgattatcacttcgtatacattgtataatgaattacccagtaagtatactgaggtccattttgcagatgggaaaactgagcttcttacctatgatcctaaataattttcataagatacacagacagtaaatgatagatctagatcttgaacatttgtctctctgactataaaacccattttctggccgctctacctgctgctgcttatggaatcaatattggtacccagagaagttgaaacctgaaagttacatgtgacttctaatgaaaggaccacagctaaagatatttatagaacttccaaattacagaggcaggtaagaaatatggtttggatgctccaacactacaatgtataagatattttgacaatgagaaggatgaggagttaaggagggagaagggatgttgacccaaaaaatcaaggatgtgagttactatgtaggacacttcaaataaagatgggtgtattagtccattttcatgctgctgataaagacatacctgagactgggtaattgataaagaaagagatgtttaatggactcacagttctatgtggctggggaggcctcacaatcatggtggaaggtgaaaggcacataatacatgatagcagccaagagagaatgagtgccaggtgaaaggggtttccccttataaaaccatcagatcagccaggtgtggtggctcatgcctgtactcccagcactttggtaggccaaggcgggcggatcacaaggtcaggagttcgagaccaaccagccaacatagtgaaactgtgtctctactaaaaatacaaaaattagctgggcatggtggcacgtgcctgtagtcccagctactcgggaggctgaggcaggagaatcacttgaaccccaggaggcagaggttgcagcaagccgagattgcaccaccgcactccagcctgggcaacagagcgagactccatctcaaaaaaaaaaaaaaaaaaagaaaccatcagatctcgtgagacttattcactaccatgaaaaccatattggggaaaccgcccccatgattcagttatctcccatggggtccctcccacaacacatggaaattatgggagctacaattcaagatgagatttgggtggggacacagcccaataatatcaatgggtgagtgtcctttccagtttccctcttgtctgtagctgagtccaacagagaattgtcacaggatgagtgtgaaggaaaacagcttgaaatcttgactttcagaaagaacagagggcacaaggattcttgtgtaaagcagcaattcatagtcttcctttaacatccttacacctagtacttgttttcaaaccattacacaatgtagtgttgattcttcttaagcatatatgtctgcaatggagaaagggacttcgctgggtggaaatgtaaagaaccatgaagtagtgtaatgtagtggatacaaacgtattatcatacctttccttacaggcaggcaatatgtggcagggcttcaaaacagaggtttcaagaccagacagttcaaatccagctttggactcgggacaggttattgaacttttctaagcataaattttctcttctatacaccaaaaagaatgattttactcatctaggttttgtgggttttaaatgaattaaatgatgtgtccagtgaagtgcctgatttaacagtatgtgctcaataaacagaactcacatttattattagaagcaagatttagaatgaaaaaccaggaatcatatctgtctatctagagcctgatcatgttcaaatgtgtttgtattctgacctgtcaattgtgacactctggacattgaccctgactcaaggtctccagaactgactgtccttaccccccagttctaagttaaccatagttttccttaccccttaagcaggaatagggatcttatttaagatcattataaggtgctacattcccttatggggtggttgtgagaatgtagtagattacctcatgcaaagcaatttagatcgtgctagcacataaatgatgaggttgcctatttttaagacccacctgaagctttaagtgggatgtttctggcacagaaatctcttcaagtgtaacgtaatctacgtccctcattggaaatcagaattcttgtaaatgacagtgtcattcttcagtaatctcaacctgtttaccagcttcctgcttaacatggtaaagttgccttataaaatgtgaaagatctctttaggctttaataatcttgcagtggtgagatttaatgggacaaaaggaaacaaaggttaggtcaaacgcactttcaagttgtttagtaacaactttcagtgtccatcagcggtcacataccatgattttcctccactgggagtcaaaggtgaaacatgtcaagaaccacacaagtcacttgtaagcaaagagacagggctggaaaagctgtgatcatcaaagtgatgttcctaatatctgacgaaactcatgttgtgattcagtggtacacaacctcggacacattataatcgcctgaaagattttaaaaatctagtccaaccataccccagacaaaataaaaggctctctgtggtaggacccatgcatctgctcgcttgtgttgcctgtttgtttgtttgtttgtcttaaaactccctgggtgattctaattttaagccaaggttgagaagtgggatataaaagttctaataaggcaggttctaggaaggagacaaaaaaataaaggacaactgcttgggtgaagggagtggttctattgtttgtgtaactaatgttcaacattaatggctcacttagctgctgcccatatctagtggtgaaacaaattaactcaaatgcaaacagcttatttatatgtacatattcccatacatttatttgaatccccagtgatactctaaaagctaattacaatgaaaaataagccattctacgtgtaaatatacatgtaattctgccagttaattgcctgaaattttcattttgttcacattcccaagtgaaaaacctcaggatttttttgtcctgaagtaacagacaacttgtgtaatctttaaaagtgtgcttctcctcaccattgtctcttaatcaaattaaatttatgagatgaaataaacccaatacattaatgttagattaatatatgttttctctggttagtttttaaacaagggaggtgctgagcagtatggaatttgatcccataaagagaataggtgtttctcagtccctggtgggaggtttcacctttggggccagaattttagtgactttatcactagaccgcaaaatcatttctgatgggccttgaagcccttatatctctgtggcccatgtagataacatagtctaagtaaaaagaaatcccattacacagaacatcataaagacagcagggatgtcagactgtccactaaccagaggccatcttgagattttttttttttttaccgttgtctttaatagaaaaagaaaaccatgatgattctacttatctcccctattccctccttcatttcctcaatattattttgtattgacttctttgcacaggtatatgtgggaaggggaacccaaaataaaaatccatttcatctctgccaccaaaatctccaccaacttacttttatctaaacccaagggaaaatgaggggcaacacatttgtggagcagttactattcagaagcaaggcagcatcacacaagaatgtattctgaattcgttgcttataccagtatttctttcctgctgttttctccgtgaattaacttgatagtaggttctggactagtggatagtgggagaattatgaaagcatctgatgaacataaaatttattatgtagaatatatcaaaaatatatgtaaatcactattttattgcttgatatgaccttacgatattgtcaaaatagatagcctatattttgctatagcaggcacttcacttctttaaaacacattttataatatcaacctttcatgcctagttagaagagagatgttctggaacacttgtctagcacacacttatgttggtgcaggcacacacacacacacccaaaataaatctaatgtgtcttggatataaattgttttataatgaaaggctaacaaaggccaccaaccattgtaataggtaagatgagcttttgacaaatccttggatcggagtatcttttatagttgatatgaagaaaaaggtgatgcattggctggcattatatctcaatacattattgctgaagtttaaaaaatttactaaagtgaattttcaatttattctttgcaaagaaatcaggcctacaataaggatatgtgtatttaaacaaatgattgaagttagcaaaatatttatgaggtccacatcttaaaattggtgctatcaaccctgtcaccccattggttgttagccaatagtagtcacagttcaaagatgatattgtcctatgtagtttctgaatcgttgttttcccttagccaattccattttatagcccttgttcaatttaaatactccatttcttagggatttgccatcactcactctcacattgttttcaatttcaatataaattgatgctgcctcttgtgttgtttctccaaatactcttcttgttaaacaagatctcctgtttctagaatggtgtgcacatttgcacattctattagaaaaaaaccagattccctctcaaaatatttgcaagtgccacaccttcaaaacacaagacagatcctccattcagacaatagaaaagaaaacaggaccacccatgtgcttttaaggcactcaggaagctgaatgccgaaatgtatatttgttttaaaatatagatgattgatcatttctttaaaaatgttttgggccaggtgtggtggctcactcctgtaatcccagcactttgggaggccgaggcaggcggatcacaaggtcaggagattgagaccatcctggctaacacggtgaaaccccgtctctaataaaaatacaaaaaattagcctggcaatgtggcaggcgcctgtagtcccagctactagggaggctgagacaggagaatggcatgaacccgggaggcggaggttgcagtgagccaaggtcacgccacttcattccagcctgggcgacaagggagaccccatctcaaaaaaaaaaaaaaaaaaaaaaaaaaaaaaaaaaaatatatatatatatatatatatatatatatatacacacacacacacatatatatatacacatatatatacacacatatatatacacatatatatgtacacacacacacacatatatatacatatgtatatatatgtgtgtgtgtgtgtgtgtatatatatatatatatatatatatatatatatatatatatatacccacatatgtattttggagcctgaagttaaccagagtgaaatagctcaacttttactgcaaaaactcaaaatgaattgttaactatttaagaaatgttacaagtaggatgatggagttccttttctaagtgtgtgggaaattgaaaatcttatgagaattagaagttatcttcatgaaactacatataagagccacaaaagtactcctagacaattggagaatgactgttctctttgttaaacctcctcgggtgttttcgttgttttttttttttttttttaattgtctggactcataatccctgaatgagctggggagtgccagggaataatctataattttaattaactatgatcatgtggttgaatcagtttgagaagatattttggggtataatcttctagaacattgcttcgccttttttctacatttaactgtttttgatttgcttctaactataaaattgaactaccgtaataatctagaaatcactgaacaaaatgcacaacaggccaagcaagtcagaaatactctatttttcttatctactcttctgttaagaaaagattgtaatttttcctcttctccccattgatgcaatgtaaataagcatgggtccactcttattataaagaaaactactctgagcctctgttttttcattggtaaactgcagacgattcttatttctttttttcatttttattttactttaagttctggaatacatgtgcagaacgtgaaggtttgttacataaatatacatgtgtcgtggtggtttgctgcacctgtcaacctgtcatctaggttttaagccctgcatgcattaggtatttgtcctaatgctctctctccccttgcccccaacccccaacgggccccagtgtgtgatgttcccctccctgtgtccatgtgttcttattgtttaactcccacttgtgagcaagaacatgaggtgtttggtattctgttcctgtgttagtttgctgagaatgatggttttcagcttcatccatgtctctgcaaaggacatgaattcattcttttttatggctgcatagtattccatgatgtatatgtgccacattttctttatccagtctatcattgatggggatttgggttggttccaagactttgctattgtaaatagtgctgcaataaatgggtttttgtgaagttaaaatgtgtgaaatcacctaagatagatgttgcaaactcaaatgcgcacaggatgcataaaatttaaaaataaacaaaagtggccaagttggagacagagaagagtgttagagaatgttgagaactggtgagcacacactgtttttaattgggaatggtgctactggtcagtgtcagtaccagctaattgctcccatggggacatggtgatccagtgctgctcaacctgatatttttcagagaaactagaaatctagattcttatgtgaaattctactgtgactaatttaacacttctgaacatctcgatgtaggctagtatctaatgggccaaactttgtaggcagtttgagatctgcagtctaacacatagaaagtatttgataaaagtgcctccttatttctcccacttttatccaaacttttggataaatatttaagttatttaagatgccccgcaggttgaaaataagtgaacaaagaatcatagacattagtagttactggttgggttttgaaatacaataaggacagtgatgactatttttgtggtctggccaaacccccaggaatctctgaagaacatagccttgcattatttggacttctctggcccctgatggcagtatgatggtttagtgacagccgaaaatgtacacgcaagtaaagacaagactgttgtggacgtggatccagacttaaatggagaataatcagtcccagaaactgacagtatggaagcccaaactctgtgttaatgagcactttgatgaagagagccaggtgggtttgaagatggactaccaatctttggtgttcctctgggcatgtggtcaaaatgccatttttactaattgttaatcacatgacaaatagcctagcatgcaaccagcaggtgatatgaaactgcaggtgaagaaattctagagcataatgcagtatagccttgttttcaggaagaagccaaaactgagctggaaaaacacaatttgggaaataaactgcaaaaacccacatgcaagaaagtttgaattaataaaatgaaatagcagaatcaatcagacagaaaacaatacatttagcactaagaaaaaaaatcagctatttggaaaaaaaagtgaaagccactaaagaatagccccaataagaagctaagccaaggaatcctcatacaggttgtggaagcatgaggaagaaaaggtgttcacaaatattgcatttaaaacgatagtaaacaggaaggccgctgcctgttcagacaggaacatgtagggtgcctctacctagatgaggtctccaaagcccaagaaatttgatcatccattacatttgctctagtactcactgaattgtaagcatcaggaagacatagatactgctttttttccactggtgcaattccagcccctaacacagtgcctggcacatagcaggcacagagaaaatatttgtgggaggaatgaatacataaataagttaataaaggaattaaatccaacaatttgatttggcctaataatggtacctactatataaggaacacctactaagtgcccagcttttatgttatttcttattttttaattctataagggaagaagaacatatatttttattctacagaggaaaaaactgaggttcagaaatcatgagtaactaaattaaagttacatgactagtaagtggcaaaagtgagatttgaacatgtggttatttaaccctaaaaacttactctttcattatgccattctgtttagcttcatccatatcaactcagggagagggactcaagttgttcaaagaaacataagacttaaatccaggttatctgctctaccccctttgccctttctaaggtaccccatgccctctttctgctttgttttcctcattgaagcccttggcaaacaatatcttttgagcatgtttcacacagcagacaccagcacgctctacaagtgtaataaatgctgatgtcagagctaccataaaagacagaagtcatttcattttacatcaagatacgagtcaccatctggaagaccagatacgccaatcttaatttgagaccagattttcaaatctaactccaatgtgaaggaaaagcttatcagtattcaaagtgaagacttgggtcactctgcctagcaaacattcattttgttaggactccctttcatgagcaaaagtaaacgcattctgcaaacagctagagctcctttctgtattggttcagactcttgtttgacaggaatagaaactcacttgggcaagaatacaacacaaggaggaaatttattataaggaaatacaatgtctcccggaacctgagggcaggaatgcatctgagactcagaaatagaccaaagatggtgtcaccctcctctttgcatctctaccctgcaaattagctttctctgcttctcatcccacatggtgaaacgtagccacccacaactccagtgattaaatgctgctatttaagagaccagtcagatgcgtgtgagaattctaaatccactttggtgcagcttgagtcagtttcccactcctggccaatccactgaggtttggtaggcaagggtcatattttataaacatgatcatactttatatacacggtgaccatatggatggagcagagctgaaaagggcttgtctctgtaaagaagaaaggagtgagggggagtgagttctgagcaagttaaccactctcaattgccttctgtactgttatctatatatactgatacaaagaaaaataactcttctgtgtacaatcaaatgcaaaggtgaaatttaaagtgagagttcactgattataaaggttttaacagattaatattttaggacaataaattggctctttgagtactctacaattcagcatgtcttgatgcacaaaatgacttttaaaactcctgtaaccattccatcatctataaccccatcccatgtatttctaaaaaccgcaatgctgtgtcagcatcatggtaagcattcatcttatgatttggtattgatgaaagtcggttacttccaggtctccctgctgttaagttactttttatgctttcttgtgagatgaatgtctccatccctgctaagaactccagctcagcctttgcatattatctcaatgatctcagacactttatctctatacattctttatggatcgcattactttcaacacctcttatctcttgcctgcaaaatcatcctccagtgcaaaagtacaagaagagcattgtctccaaccacctttctctctcggtgatggcttcgtcaactctccataggctaatcacatttcagaataatgctgtttggggatgaatttatctggtgctgatttatcaaaaccaaatctttgtataagaagattctcttttggcatgattctaccagatttttttgtgtgttcccacctgaactgtaattctcccaaacataaatagccttctagcctcatttttctctctgcttttggatcagtgcttgtcatcaaaggcaagagcttgcttttgttaggagcaggactgttttctattgtgtatcccactccagacagtggtgttatcatttgacaatatctctcaggactttttattaccatgcaactaagttttaaacctattttgattcaaacgaagttgattaaaatcattaagtgctggcttatccaataaagcatattcggagtcattcagaaaatacatattggcatacttactccacacaagtcagtgggcaaaaaagaatggagatgaatcagatgttgtccctgaccttaaggaagtcgtgatctatacattttgtatataaataagcccaatcaaatttcatgcctgggaaaagtcaatatcagattaacttatagatgatttccaaggactactatgaatcattcttttctttgttcaattcaattcattaaaacagatgtgaagtctgctttttcattcttaacatccttatttaacagtaataactaatactttttgaatgttctctgtgtatcaggctcagtgctacatagtttacatacacaagtgattcacatatgcagccaagtttgagaccattgctatagcctattttttgtatgtgcatatataaatatcccacagaggcttctaatatacaatggaggggaaagaaaacctctgattttagctctactgcagtcaaaagtgaaagaatctctaaagaagcagccaaagtatttatatatttttaaagccttcgaaaggcacagccagagagtttttaagaaccatctcctaattaagtgatgtttttcattgaccatctactctgttttaaactttatctattgtttgtctttgcactagtatttgttgtatcagcccatctccaagggtctgcacaactgatcaggatataggccttttgagctccaggtcctcaatgttaatcaattttatgatattcttgagctgaaaagggacatttcattgcagtgtttaagtggttcagtgtttaatcttggaatcgagttatttggaattctatcctagttctttttttttttaacttttattttaagttcaggggtacatatgcaggtttgttacatagggaaacttgtgtcatgggttttttttttacagatcatttcatcatccaggtattaagcccagtacccattagttagttttcctggtcttctccctcctcccaccatctaccctcaagtaggcccctgtgtgtgttgttcccctcattgtgtccatgtgttctcatcatttagctcccacttgtaagtgagaacattcagtatctgattttctgttcgtacgttagtttgctaagaataatggcctccaactccatccatgtcgctacaaaggacaggatctcattcttttttacagctgcgtagtattccatggggtatatgtaccacatcttgtttatccagtctaccatgaggggcatttaagttgattccatatctttgctattgggaatagtgctgcaatgaacatatttgtgcatgtgtctttgtgatagaatgatttatattcctttgggtatatacccagtgatatggtttggctctgtgtccccacccaaatctcatatctaattgtaattcccacatgttgagggagggaggtgattggatcatgagagaggttttcccccatgctattctcatgatagtgagtgagttctcatgaggtctgatggttctataagtgtttgacaattcctccttcacatgctcctctctcttctaccaccttgtgaaaaaggtccttggttcctctttgccttccaccatgattgtaagtttcctgaggtttcccaagccatatggaactgtgagtcaattaaacatcttttcttgctgaattacccagtctcgggtatttctttatagtagtgtgaaaacagactaatacagtaaagttgtaccacagagagttgggtgctgctataaatagatacttgaaaatatggaagcaactttggaactgggtaatgggcaaaggttggaacagtttggaaggctcagaagaagaaagtaggatgtgggaagtttggaacttcctagagacttgttgagtggttttgaccaaaatgctgatactgatgtggacaatgaaatccagacttaggtggtcttagatggagctgaggaacttatctggcactggagcaaaggtcactcttactatgctttagcaaaaagactggcagcattctgccctgccctagagatctgtggcacttttaacttgagagagatgatctgaaattggaatttatgtttaaaaaggaagcagagctaaaagtttggaaaatttgcagcctgatgatgcaatagaaaagaaaatcccattttcttggtagaaattgaagctagctgcagaaatttgcataagtaacgaggatttaattgttaatcgccaacacaatggggaaaatgtctccagggcatgtcagagatcttagcagtatcccctcccatcacaggccttgcagcctaaaagtaacaagtggcctcaaagcctaggagaaaaaaatggtttcgtgatttgggtccagagtcctgttgctatgtgcagcatcaggattttgtgccctgcatcccagctgctccagctccagccatggctaaaaggagccaaggtaccactcggcctgttgcttcagaggatgcaagccccaacttttggcagcctccacgtggtgatgggcctgtgggtacacagaagaattgaggtttgggatcctctgcctaaatttcacaggttatatgaaaacgcctggatgtccaggcagaagtctgcttcaagggcagggccctcatggagaaactctgctggggtagtgtggaagggaaatgtggggtgtgaggccccatacggagtccccactagggcactgcctagggagctgtgagaagagggccaccatcctctagaacccagaattgtagatccactgacaccttgaaccatgtgccttgaaaagctgcaggcactcaatgctagcccatgaaaaggctgccatggctgtgtgagctcacatcttgcatcaacatgccaagaacatgaaacatggagtcaaaggagatgattttggagctttaagatttaatgactgccctgctggattgcagattttcatggggcttgtaacccctttgttttggcgaattcctcccacttggaacaggagcatttacccaatgcctgtaaccacattgtatctaggaagtaactaatttgcttttgattttttaggctcataaaatcaagaatggcagaagggacttgccttctctcggatgagactttggactgtggatcttcgaattaatgcaggaatgagttaagactttgaggactgttgggaaggcatgactggttttcaaatgtgaaaagacatgagatttgggagggtctaagagcaggatggtatggtttggctctgtgtccccatgcaaatctcatctcaaattgtaattcccacgtgttgagggagggaggtgattggatcgtgggagaggttttcgccatgctgttctcatgatagtgagttctcatgagatctgattgtttcgtttcgtaagcaaagcctttgacagttcctctttcacacactcctctctctcttgccaccatgtgaagaaggtccttgcttcccctttgccttctgccacgtttctaagtttcctaagacctcccagccatgtggaactgtaagtcaattaagcctctttcctttctaaattacccagtctcgggtatttctttatagtcgtgtgaaaacagaataatacacccagtaaagagattgttgggtcaaatgttatttctgttttcagttttttgaggaatcaccacattgtcttccaccatggctgaacaaatttacactcccaccaacagagtataagcattactttttcttcacaaccatgctagcatctgttattttttgactttttaataatacccattctgatttgtgtgagatggtatttcatggttttcatttccctttccctaatgatcagtgatgttgagcttcttttcatatgattgttcaccacatgtatgtcttcttttgaaaaatgtctgttaatgtcctttaatgggattgttttattcttgtaaatttgtttaagttccttacaaatgctggatattagaccattgtcagatgcacagtttgcaaatattttctcccattctgtaggttgcctgtttattctgttgatactatcttttgctgtgcagaagctctttagtttaattaaatctcttttgtcaacttttgcttttgtcgtaattgcttttggcatctacatcatgaaatctttgcctgttgctttgtcaagaatggtattgccaagtcgtcttccagggatttttagaggtttgggttttacacttaagtctttaattttaaatgtaggttgtcttccagggtttttacagtttgggtttttacatttaagtctttaatccattttaagttgatttttttttttgagtctgtctccaaagttctttttttttttaaattttattattattatactttaagttttagggtacatgtgcacaacatgcaggtttgttacataggtatacatgtgccatgttggtgtgctgcacccattaactcctcatttagcattaggtatatctcctaatgctatcccttccccttccccccaccccacaacagtccccaatgtgtgatgttccccttcctgtgtccatgtgttctaatcgttcaactcccacctatgagtgagaacatgcggtgtttggtttttcgtccttggcaatagtttgttgagaatgatggtttccagtttcatccatgtccctacaaaggacatgaactcatccttttttatggctgcatagtattccatggtgtatatgtgccacattttcttaatccaatctatcattgttggacatttgggttggttccaagactttgctattgtgaatactgccgcaataaacatacgcgtgcatgtgtctttatagcagcatgatttataatcctttgggtatatacgcagtaatgggatggctgggtcaaatggcatttctagttctagatccctgaggaattggcacaccgacttccacaatggttgaactagtttacagtcccaccaacagtgtaaaagtgttcctatttctccacatcctctccagcacctgttgtttcctgactttttaatgatcgccattctaactggtgtgtgatggtatctcattgtggttttgatttgcatttctctgatggccagtgatgatgagcattttttcatgtgtttttttggctgcataaatatcttcttttgagaagtgtctgttcatatccttcgcccactttttgatagggttgtttgtttttttcttgtaaatttgtttgagttcattgtagattctggatattagccctttgtcagatgagtaggctgcaaaaattttctcccattttgtaggttgcctgttcactctgacagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagctagttttcccagcaccatttattaaataaggaatcctttccccattgcttgtttttgtcaggtttgtcaaagaccagatagttgtagacgtgtggcattatttctgagggctctgttctgttccattggtctatatctctgttttggtaccagtaccatgctgttttggttactgtagccttgtagtatagtttgaagtcaggtagcatgatgcctccagctttgttcttttggcttaggattcacttggcaatgtgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttctttgtagcctcttttatttcattgagcagtggtttgtagttctccttgaagaggtccttcacatcccttgtaagttggattcgcaggtattttattctctttgaagcaaatgtgaatgggagttcactcatgatttggctctctgtttgtctgttattgttgtataagaatgcttgtgatttttgtacattgattttgtatcctgagactttgctgaagttgcttatcagcttaaggagattttgggctgagaagatggggttttccagacatacaatcatgtcatctgcaaacagggacaatttgacttcctcttttcctaattgaataccctttgtttccttctgctgcctgattgccctggccagaacttccaacactatgttgaataggagtgatgagagagggcatccctgccttgtgccagttttcaaagggaatgcttccagtttttgcccattcagtatgatattggctgtgggtttgtcatagatagctcttattattttgagatacgtcccatcaatacctaatttattgagactttttagcatgaagggttgttgacttttgtcaaaggccttttctgcctttctatctctattgagataatcatgtggtttttgtctttggttctgtttatatgctggattacatttattgatttgtgtgtgttgaaccagccttgcatcccagagatgaagcccacttggtcgtgttggataagctttttgatgtgctgctggattcggtttgccagtattttattgaggatttttgcatcaatgttcatcaaggatattagtctaaaattctcctttttgttgtgtctctgccaggctttggtatcaggatgatgctggcctcataaaatgagttagggaggattccctctttttctgttgattggaatagtttcagaaggaatggtaccagctcctccttgtacctctgtttaagttgatttttgtatatagtgtgaggaacatgtccagtatcaatcttctgcttatggttagccagttatcccagcactatttatttaatagggaatcctttccctgttgcttgtttttgtcagctttgtcaaagatgagattattatcgttatggggccttatttctgggttctctattctgttccatttgtctatgtctctgtttttgtagtagtaccatgctgttttgcagccctgtattatagtttgaagtcaggtagcgtgatgcctccagctttgttctttttgcttaggattgcctttttgagcttttttatggttccatatgaactttaaaatactattttctagttctgtgaagaatgtcattggtagtttaatagaaatagcattgaatctacaaattgctttggacagtatggccattttaatgatattgagtcttcctatacaagagtatggaatgttttccatttgtttgtgtcatctctgatgttgttgagtaatgttttatagttctttctgtaaagatctgtcacctctctggttagctgtattcccagttattttatgttgtggctgttgtgaatgtgattgtgttcctggtttggctttcagcttgactattgttgatgtataggaatgctagtgatttttgtacattgattttgtatcctgagacttagtcaaagttgtttattagcttaaggagcctttgggctgagactatagggttttctagatataggatcatgtcatcagcagagagggatagtttgacttactctctttatttctttctgttgtctgatttcaccagccaggacttccaacactatgttgaataggagtggtcagagagggtatccttgtcttttgcgggttttgaggggaaatgttccagcttttgccaattcagtatgatgtcagctgtgggtttgtcgtagatggctcttattattttgaggtatgttccttcaatacctagtctattgagagtttttaacatgaagcaatgttgaattttgtgaaagccttttctgcatctattgagataatgtggtttttgtcttttgttttgtttatgcgatgaatcacatttatttttttgtgtctgttgaacaaactttgcattccaggggtgaagcctacttgatcgggtggagaagctcttacgatgtgctgctggattcagtttgctggtgttttgttaaggatttttgcgttgatgttcatcaaggatattggcctgaagtttttttgttgttgttgtatctccaccaggttttggaatcagaatgatgcttaccacatagaatgaggtagggaggagtccctcttcaatttttgaaatagtttcatcaggaatggtatcagctcttctttttatatctggtagtattcagctgtgaaaccttctggtcctgggctgtttttggttggtaggccattaattactgatttaattcagagctcattattggtctattcagggattcaacttcttcctggttcagtcttgggaggatgtatatgtccaggaatttattcatttcttctagattttctagtttatgtgcatagaggtattcataatattttctgatggttgtttgtatttctctggggtcagtggtaatatatttgctttttcatttctgattgtatttatttggatcctctctcttttcttctttattagtctagctagtggtagaggtattttattaattttctcaaaaaatgcctcctgtattcattgatattttaaatggcttttcatgtgtcagtcttcttcagttcagctctaatttcggttatttcttgtcttctgctagctctgggattggtttgctcttggtttcctactttttgttgtggtgttgggttgttaacttgagatctttctttatgatatggactttaagagctctaaatctatcttaacactgctttagctgtgtcccagagattcttgcatgttgtatgtttgttctcattgttttaaaaaacttgatttctatcttaatttcattatttaaccgaaagccattcagagcaggttattcaatgtaaatgtacttgtatggttttgagtgaatttctttgttttgatttctaatttcattgtgctatggtcagaaagattgtttattgtggtttcagttcttttgcatttgctgaaaagtgttttacttacaattatgtgattgattttagagtaagtaccatgtgacaatgagaagaatatatattctgttgttttggggtagagaattctgtagatgtttatcagttccatttggtacagtgctgagttcaagtcctgaataactttttgaattttctacctcaataatctatctaatattgtcaatggggtgttaaaatctcttactattattgtgtgggagtctaagtctcttctaaggtgttcaagaactttctttatgaatctgcgtgcttctgcattgagtgtatatatatttaggatacttaggtcttgttgaattcaaccctttaccattatgtaatgcccttctttgtcttttttcatctttgttggtttaaaatctgttttgtctaaaacaaggattgaaatcattactttttttgtttgtttttcattggcttgttggattattctgtgtccctttattttgaacctatgcatgtcctgcttctataattactaactgtgggaccttgggtaagatggttgccctttcttaacctcgcactcctcatctgttaactggaggtaataatagagcctacctcactgggttttcgcccctgaggattacatgagataatgtagcatctagactattacgaggaaggtggaaagaactgttttcaagttgtttcccataggtgggataaattttacttattttgaaaacttttccaatgactgtgtaaacaacatggcgtttccccagcataaatcctgatcaaagactaaagtacttgctaaaccaggttattagcagataatagtcagtgtcagagtaagtggctaagaaaacaagacttcaaaacctgaagacctagatttgaatccttggttttcatcgtattagctgtgggattttgagacggcacttaaagtctctgggcctgttttatcttttttttaaaaggatacactattcgtttctgccttgaaagttgttataaagactgaataaatccgcatgaagcacttagtgcaatatgtggcatgttgtaggcaatctcaagtgtttgctatgactagatttattcataatgttattgttaaacatatctagaagccattacaaactatagcctgtaggccaaactctacttgcctcctttttttttaagtagtttcctactggaacacagtcacacttactcatttacaaattatttgtcttttcaaatttttttatttgaaatacaattgtacgtatttatgaggtatatagtgatgttttgatacatatagcatgcagtgagcaaatcagggtaattagcatatccatcatcttgaacattgattatttcttagtgttgggagcattgagtatcctttttctagttatctgaaactgtataatatattagtgttaactctggccatcctacagtgctaaaagttggctgcttttgtgttacaagtagccacagagttcacatggtcccccgagcctaatactttcactatctggcccttcacagaaaaactttgctgacttgctatgaacaagacattgtgccaaatttattctccacaccatgaataatattttttcagtaacacacgatagatactgttgttatccttattttttatatgaggaaacaaagactcagatttaccacttaaaatgtccaaagtcctacaactaacaaatgacacagctggaatttgaagcacttttatatgacactacagttcacaatcgtaatcatatcacattttttagattaggttagattgttctctggtgatgtgtagtgactgaggtggttacgagtttttttttgtttgtttttttagttgtctctagtatcctatgtagatagcatggagagcacatatttgaaaagtccacatttgggtcaatcatttccattttacaagtgttaagaactcatctagggtgctatgcacatgatctagcctgacaatcctggaggagactggcctagctacagataggtttttctactaccatcttttttgacaactatccttcccttccctggagagaactgtttgccttcaccaagaatgctggctccagaaggccagctgtgtagctgatgaattagttttgtagactattgctttcttttctgttggcctcttgggtgtctgctctgtagctagtaggtgtgaagcttatagaaacgtgtgtagctgcagctttgcctgccagaagcttattttgtttgagacaataccatttccctttgattcatttttgaaatatattatatgcataagaattaggtcctaggaacaatttcccatgagatcaatttgcaagactctttagtttagaaagaaagatcattctcttgtgtgtattggtttgatatggaaatacatatacttgccctacatctagattgctagtgtgctcagaattttctttataaagttcaaaattaaatccatacactctgtgcctaattttatttttttttttggtgtctgcatgcagacactttcttaaggatggagcccttaagcacaagaagagtgtgatggaacaaatctcaaatctacagcttcaaaaatctgtctttgttgttggctgaaagcaggactaaaagttctggtgactataaatccagacattgtactttcagtgataattaggtttctcacagatctgacattctctatgctagactctaaatggcagtctatagctcagtttgcaaaagggggctattttaagacactaaggaagagattattggagttctccagttacacataagcctctccttaaggtcattgattaaacgtaatgttcgtggagcctagggtatttatttattttttacattaaatagtgccactcaggcgatttttattcatgctattctgtgccatggaaatgttgtatctcaacagaggattgtggtatgagtttactccatgttcaaccttcaacaagcatttactagtaaataactctgagccagacattatgatgggtgctggggaaataaaggcatgatgatgtattagattgatttattttcccagattttctgtttcctttagtgagtcgtttttctgctttcactcaggacataatttgaaaggcaattctctgctgtagtcaaagattccccatatgaggtccatcagtagtacatgtaggctctaacagggatacaaaaaactgtttttcccccttcatggtggaggaactcatggttactttctgagaccacagccttggaaggttatttataatatgcatttcattcagctctaggtttttatgaaaaacaattattattgtgtttaacaaaagtatctaaaccatttctgactatatcattaaaactaattcctgagattcaaagtggaacttccctgttccactaaaataactcatgttacttcatgaatgaatgttaagccttaattccataataggcatattatatatagtttgaaaaggcatattcagtatttcaatatgtcatttttagaaaccacgtaaaattcctcttgttttaactaacattagaaaaattagggtcagagaaatcgtggcggctggagatatgaagaaaaataacaatttttaccagagagttttaggggacatggcattgagtgaacacgttagtatcactagatgtgaactatatgtttataaaaaggtagtatagatctaaagaaaaaagattgcattcattaaattttatttgctttaggtaacaaacttttatgaataaagctccaaagcacattagcaaatttagtaactatattacacagaggcctcaatgtgcattcactgtgaatttagacctttctatttttttaaacattattgctctaagcctattttcatctatatttttgcattttttctctaatatatcatagctaacgtttgtctctgtaattttccatttttgctgtattcagctcattttgccacctatgacgttttttttatctaaccaccagcatcctttttatttgcttttcccaaccaattcccacatctacagagttagatggagtgctaacaggatctttgttttgtcatacgctttcggcctatattccaaaactctgaaactgacaactctactgaaatgaatcattcttaaaaaagacattctactttttaaataatttatggccatctgatttttttttaatgtaaacttcagggtcagaagggaccttttggatggtgtttttaaaccttaataattagccaacatttctatcataatagaatagagatctccatgtgattagccattaatacttcagctttactttgaaatctgtttcttacaagattaagttgtaattttcacttaatttatactttttgagtgaactttttgttttacaatgaaagtaagaaaagtatctctgaccctgggttaaaggtcacattactatttaattaaaataaaactgtgggtttgctaagcagtacatggtccacgtttataaggagagttctgtatttttgaagttcatccatgtaggttgatattttgggaaacatgcctagacagtctttattctgcctcgggggactttgtatgtgtaaaaccatgacatgcttggccttgatttacaaatgatcgcatgtcaacttaaatataatatgtatttgacagggctttctaggctcacattttttaccagaggaaacactggccatacacaaaaagctttcatcaacctggcctctttgtgactaaaaatattgtattcatttcttatattatctttaataactgtcccattttttctattatgaataaggcatttaatatctttgtatgcataactttgtaaacttttgcaagaatatcaatagaagagattttaagaattgatattactgggtcaaagggtatgtccattgaaatattagtaaatactgccaaattatattcttttaaaaagtatctattggttgattcccgggcaagatggccaaataggaacagctccggtctgcagttcccagcaacaacagcagagaaggcgggtgatttctgcatttctaactgaggtacctggctgatctcattgggactggttagacagtgggcgcaacccacagagggtgagcagaagctgggtggggtgttaccccacccaggaagtgtaagaggttgagaaactccctcccctagccgagggaagcaatgagggactgtgctgtgcgggatggtgctatccggcccagatactacgcttttcccaaagtctttgcaacccacagaccagatttgcttgggtgcctacaccaccagggccctgggtttcaagcacaaaattgggcagccatatgggcagacactgagctagctgcaggactttttcttgtaccccagtggtgcctggaatgccagtgacaaccgttcactcccctggaaaggggggtgaagcaaggaaggtgagtggtcttgctcagcagaccctacccccatggaactcaacaagctaaggtccactggcttgaaattctcacggccagcacagcagtctgaagtcaacctgggatgctcaagcttggtgggggaaggggcgtccgccattactgaggcttgagtacagggttttcccctcacagtgtaaacaaagcctctgggaagttcagactgggcagagctcaccacagaaccacaaagctactgtagccagactgcctctctagatccctcatctctgggcagggcatctctgaaagaaagggagaaaccccagtcagggacttatatataaaactcccatctccctgggacagagcacctatgggaaggggcagctgtggggacagcttaagcagacttaaacattcctgcctgccagctcagaagagagcagcagatctctcagcacagcacttgagctctgctaagggacagactgcctcttcaagtgggttcctgacccccatgccttctgatggggagacacctcccagcaggggttgacaggtgccttatacaggagaggcagcgggcatctggcaggtggccctgtgggacaaagcttccagaagaaggagcaggcagcaatctttgctgttttgcaacctctgctggtgatactcaggcaaacagggtctggagtagacctccagcaaactccagcagatctgcagaagagggatctgactgactgttagaagaaaaactagcaaacagaaagcaataccatcaacatcgcaaaaaggatggccatgcagaaactgcatctgaaggtcaccaaaatcaaagaccaaatgtcagtaaatccacgaagaaggggaaaaagcagcacaaaaaggctgaaaattccaaaacccagaacacctcttttcttccaaaggatcacaactcctggccagcaagggaacaaaactggactgagaatgagtttgatgaattgacggaagtaggcttcagaaggtgggtaataacaaaaatcctctgagctaaaggaacatgttgtaacccaatgcaaggaagctaagaaccttgataaaaggttacaggaactgctaactagaataaccagtttagagaagaacataaatgacctgatggagctgaaaaacacagcgtgagaactttgtgaagcatatacaagtgtcaatagccaaatcaatcaagtagaagaaaggatattagagactgaagatcaacttaatgaaataaagcatgaagacaagattagagaaaaaagagaatgaaaaggaatgaacaaagcctccaagaaacatgggactatgtgaaaagaccagacctatgtttggtgtacctgaaagtgacagggagaatggaaccaagttggaaaatactcttcaggatattatccaggagaacttccccaacctagcaagacaggccaacattcaaattcaggaaatgcagagaacaccacaaagataatcctcaagaagagcaaccgtaagacacataatcgtcagattcaccatggttgaaatgaaggaaaaaatgttaaggacagccagagagaaaggtcgggttacccacaaagggaagcccaccagactaacagtggatctctctgcagaaaccctataagccagaagagagtggggtccaatattcaacattcttgaagaaaataattttcaactcagaatttcatatccagccaaactaagctttataagtgaaggagaagtaaaatcctttacagacaagcaaatgctgagggattttgtcaccaccaggcctgccataccagagctcctgaggaagcactaaacatggaaaggaaaaatcagtaccagccactgcaaaagcatatcaaaatgtaaagaccatcaacactatgaagaaactgcatcaactaatgggcaaaataaccagctggaatcataatgacaggaccaaattcacacataacaatactaaccttaaatgtaaatgggttaaatgccccaattaaaagacacagactggcaaattggataaagagtcaacacccatcagtgtgctgtattcaggagtccgatctcatgtgcaaagacacacataggctcaaaataaagggagggaggaatatttaggaaagcaaaaaaaaaaaaaaaaaaaagtagggattgcaatcctagtctctgataaagcagaatttcaaccaacaaagatcaaaaaagacaaagaaggatattacataatggtaaaggattaatgcaacaagaagagctaactatcctaaataaatacgcatccaatacaggagcacccagattcataaagcaagtccttagagacctacaaaaagacttagactcccacacaataatagagggagactttagtaccccactgtcaatatcagacagatcaatgagacagaaaattaacaaggatattcaggacttgaactcagctctggaccaagcagaactaatagacatctgcagaaccctccatctcaaatcaacagaatatacgttcttctcagcaccgtatcgcacttattctaaaactggccacatacttggaaataaaacactcctcagcaaatgcaaaaaaacggaaatcagaacagtctctcagaccacagtgcaatcgaattagaactcacgattaagaaactcactcacaaccactcaactacatggaaactgaacaacctgctcctgaatgattgctaagtaaataacaaaatgaggcagaaataaataagttctttgaaaccagtgaacacaaagacacaacgtaccagaatctctgggacacagctaaagcagtgtttagagggaaatttatagcgctaaatgtccacatgagaaagtgggaaagatctaaaatcaacaccctaacgtcacaattaaaagaactagagaagcaagagcaaacaaattcacaagctgtcagaagacaaaaaataactaagatcagaacagaactgaaggagatagagagatgaaaaatcctccaaaaaatcaatgagtccaggagctggtttttgaaaatattaacaaaatagaccactagccagactaataagaacagagagaagaatcaagtagacacacacacagagaaaaaaaagataaagggaatatcaccaccgatcccacagaaatacaaactatcatcagagaatactataaacaactgtacacaaataaactggaaaatctagaagaaatggataaattcctggacacatacaccctcccaagactaaatcaggaagaagtcaaatccctgaatagaccaatagcaagttctcaaataaaggcagtaattaatagcctaccaatggaaaaaaaaaaaaagccaggattagatggattcatagccaaattctaccagactttcaaagagaagctggtaccattccttcaaaaactatttcaaacaacagaaaaagaggcactcctccctaagttattttatgaggcaagcatcatcctgatagaaaaacctggcagagacacaatgaaaaaaagaaaatttcagggcaatatccctgttgaacatcaatgcaaaaatcctctataatatactgacagaccgaatccatcagcacattaagaagcttatccagcacaatcaagtcagcttcatcccgaggatgcaaagctgattcaacatatgcaaatcaataaatataatccatcacagaaacagaatcaatgacaaaaattacgtgattatctcaatagatgcaaaaaaggcctttgataaaattcaacaccccttcatgctaaaaacactcaataaactaggtattgatggaatgtatctcaaaataataagagctatttatgacaaaaccacagccaatatcatacagaaagggcaaaagctggaagcattccctttgaaaactggcacaagacaaggatgccctctctcaccactcctattcaacatagtattggaagttctagccagggcaatcagtcaagagaaagaaatatgcatttagaaaaccacatcgtctcaatccaaaaactccttaagccaataagcaacttcagcaaagtctcaggatacaaaatcaatgtggaaaaatcacaagcattcctgtacaccaataatagacaaacagagccaaatcatgagtaaactcccattcacaattgctgcaaagagaataaaatacctaggaatacaacttacaaggtgtgtgaaagacttcttcagggagaactacaaaccactgctcaaggaaataagagaggacacaaacaaatggaaaaacattccatgctcatggataggaagaatcaatatcgtgaaaatggccatgctccccaaagtaatttatagattcaatgctatcccaatcaaactaccattgactttcttcacagaataagaaaaaaaactactttaaatttcatatggaaccaaaaaggagcccatacaaccaaggcaatcctaagcaaaaagaacaaaattggaggcatcatgctacctgacttcaaaccatactgcaagactacagtaaccaaaacagcatggtactggtaccaaaacagatatatagaccagtggaacagaacagaggcctcacaaataacactatgcatctacaagtacctgatcttccacaaacaaaaacaagcaatggggaaaggattccccatttaataaatggtgttgggaaaactggctagccatatgcagaaaactgaaactgaacctcttccttacactttatacaaaaaataactcaaggtagattaaagatttagatgtaagtcctaaaaccataaaaactctagaagaaaacctaggcaaataccattcaggatataggcactggcaaagacttcatgactaaacaccaaaagcaattgcaacaaaagccacaattgacaaatgggatctaattaaatcaaagagctctgcccatcagaagaaactatcatctgagtgaacaggcaacctaccgaatgggagaaaatttttgcaatatattcatctgacaaagggctaatatccagaaactacaaggaacttaaatttgcaagaagaaagctaacaaccccatcaaaaatggccaaaggatataaacaaacacttttcaaaagaagacatttatgcggccaacaaacatatgaaaaaaaaactcatcactggtcgttagagaattgcatattaaaagcacaatgagataccatctcaaccagttagaatggcaattattaaaaagtcaggaaacaacaggtgctggagaggatgtggagaaataggaacgcttttacactgttggtgagagtgtaaattagttcaaccattgtgggaaatggtgtggccattcctcaaggatctagaactagaaataccatttgacccagcaatcccattactggctatatacccaaaggattataaatcattgcactataaagacacatacgtttactgcacatgcacacatacgtttactgcagtactgttcacaagagcaaacacttgctaacaacccaaatgtccatcaatgatagacaggataaagaaaatgtggcacatatacactatggaatactatgcagccataaaaaagaatgagtttatgtcctttgcagggacatggatgaagctggaaaccatcattctcagcaaactaacacaggaagagaaaaccaaacactgcatattctcactcataagtgagagttgaacaattagaacatatgggctcagggaggggaatatcacacactggggcctgttggaggatggtgggcaagggagggatactattaggagaaatacctaatgtagatgacaggttgatgggtgcagcaaaccaccatggcacatgtatacctatgtaacaaacttacatgtatcccagaacttaaagtataataataataataataataaaatatctactggcattctccccaattgtgtttgagagtgtctgtgtctgcataccttcaccaactttgatattagcattctttataatttttgccaaactgggggaaaatgtttgtagatttactttatatttccttattattttgtgaggacttttgattttggtcatttggtttttgtttattttagagtaaaaaccctgttgagatgagaattttataaatcagaattctagtgtttgcttcattttaagacaaattttaaaaattgaaatgtaatatatactgatataaacagacaagtcatgaatgaacagctcagtggatttccattaactgaactcacccatgataccataactcacatcaagagctagaatgttaccagcaatccagaagtatccctggtgtcccttctctgtctctactacctttcccaaggtagctactgtcccaacttctagcactacaggttactcttgtctttaaaaacaaaacaaaaaagaaccttttatttaaatggacttctatactatatcttctttggtgactggctgctttcattgactgtgttgcatgtagcagtagatggttccttctcattgctgtacactagtctactgcagtaacataccacaatttagttttgctattgataaacatcacagttactttcaatttgggactataatcaacaaaactgccatagacatttctgcatacttcttcaatggatgtatttgttattcttgggcatatgcctagtagaaggataatgtaaaatttatccatacataaagttatccaaaccttccataaaagtttaaacaattctattaaaatgctgctttcatcacgttattttacctgttaaaatcttttaagaactactcagtgtcctctgaatagaataagaacatttttaaatgaattttaaggtccactatgaatttacaactgattgtctttcaccctttcccttgctctcatcctcaatggcatcttccttcattttgaccccagcactccaatctccagccatacttagttgtttgccattttgtttggaggaaaaatcttagtattaaccatgaaagacttaaacaaaactatggaggaaaaaaaggagaaaggtgctgtttctctaagactgttctcgtgaggatcttccgttttctttcttttttttaaatttattgttttactttaagttccgagtacatgtacagaacatgtaggtttgttacataggtatgcatctgccatggtgggttgctgcacccatcaacccatcacctaggttttaagtcccgcatgcgttaggtatttgtcctaatgctgtccctccccttgccccctacccgccaacaggccccggtgtgtgatgttcccctttctgtgtccatgtgtcctcactgttcaacttccatttatgagtgagaacatgtggtgtttggttttctgttcctgtgttagtttgctgagaatgatggtttccagcttcatccatgtccctgcaaaggacataaactcattctttcttttacggctgactagtattccatggtttatatgtgccacattttctttatccagtctatcattgatggacatttgggttgtttgcaagtctttgctattgtgaacagtgacacaataaacacacgtgtgcatatgtctttataatagaatgagttataatcctttgagtgtatacccagtaatgggattgctgggtgaaatggtatttcttgttctagatccttgaagaattgccacactgtcttccacaatggttgaactaatttatactcccaccaacagcgtaaaagtgttcctatttctccacatcctctccagcatctgttgtttcctgatgataatttattttgctgtgcagaagctcttcagtttaattagatcaatttgtcaattttgtcttttgttacaattgcttttggtgttttagtcattaaatattttcccatgcctatgtcctgaatggtatcaatatcatgaaaatggccatactttccaaagtaatttacaaattcagtgttattcccatgaagctactattgactttcttcacagaactagaaaaagctactttaaatttcatatggaataaaaaaaagagcccgtatagccaagacaatcctaaacaaaaagaacaaagctggaggcatcacactacctgacttcaaactatgctacaaggctaaagtaaccaaaacagcatggtactggtaccaaaacaaatatatagaccaatggaaatgaacaaaggcatcagaaataataccatacatctacaactatctgatcttccacaaacctgacaaaaacaagcaatggggaaaggattccctatttaataaatggtgctgggaaaactggctagccatatgcagaaaactgaaactggaccccttccttacaccttaacaaaaattaactcaagatagattaaagacttaaatgtaaaacctaaaaccataaaaaccctagaaggatcttccattttcacaaatactgtctggagctagcatcccttcaaatgtctttcctgcattattgactgcagtagaagtggagtataaagcaactgggcctccccaattgcttcagatcccatgtcaatctcattaacctgaatatagtttactgtgaggaagaaaactttaaccttaggttgaaatttatgtattttttccctagctgttccttgatgttatttcattacgaacattaacttacgtaaatgtttcttcagggaactgaaacttcagtaactatattctgctcttcagattatcagtcataaaatgtctgctgtcaaattgacatctaatcaaagaagaatgttcattttcttgcagacttctcactgcagagtcactcattctttatttacaacttatctaaaggaataagtttatattctaaaaattgcattcttttaaataaagtagaaaaatttctctctcatttagtctaactgacttaacatccaaattactctttttccacacattgcttctacattgatcaaatgacaattaatcaatattttttggccataaaaatgttaagttctaatttacataactttagagttgaactagattattcatgacagtcaatataattaaaacatcaaaggtgataataactacgaagttttacaatccaagtccagctatactgagcagttcatattactccatttctttttcatgattatcttatgaagaaggtgtgcattttacaaagctcaaagagtttaagaaatgtatccattttacatggtttataagtagtagggttgggatttgaacccctgtttgagagattgctgagcccaggagatttcactgtagtattaatattttgccaattatttcatttctctgttatttgggatttctttacaacagaggctcaaccatccagttgactaagaatcagttcaattgactgtttaactatcaattgctaggaatcaatgatggtgagttatttggacttcaccttcagtagaagtctcagaaaatctgtatctaattgattccctttcccaattgctctcagtaaatttaaagatattcaacaattcttgcaggaccataattcatgttagcctaataaaattccaataatttcataataatggatatatattaataataatagtaataaaaacgactacccactttgagtggttactgtgttctaggcactgtgctaaatgctttatgcacatttttattattcagtcctcatatctactcaatgaggtacatagttggaacactaaaacttaattctaaatgaagcaaataaaaggaggaccatctattgacatgcagaaacaaaaattacagaggtagagctgtcagcattggatctagtgctcaaaggtgtcacaagggctgggttcatctataccgcctctctgcactggtctccatgtcagctcaatctcgactcacacaggatctctccaaaggtgagctcacattttaaagttcaacagaaataaagctgctttttacccaatgtttccacacagcccaggtccagtctgacttaaccagcttggatgacaagcctatccttaaaccattcactgtggctgggaaaagactacgctgtttggccaggtcacaatcccactcctggagctgttgttcatttgcactgcatcgactgaaaatggggtaggggtggtcactctacaaaggaaaccaggtgtgctgttaccaaaagagggaatgagacataggcaagcaggaacagtggatttcatctacatatagtaatagtcatcattattcacattttacagataagtaaattaaggttcaagaagtttcatttgttgagattcaccagttataaaatacaatgacagtattccagccaatgacactcagagtaattacaaaactatagtgcattcctagcaactaagtctatacatacaatgaagattctcaagagagctttattgcttatgctgcttattccagccctgataaggaaccatcagcatttgaaccccagtaatcctcccaactataaggagaacagagtcatattcaggctgagtgaagtagaaactgctaaattctattcctctctaaacaatcagattctttaagagacaaatctgtttttatatttgtataaatcttatatatactgttgattcatagaagatgttattggtaatgactcaactatcaaacttagtggacatttatacatggaaattacctaattaattcctaactacacacttgaggggaaaatacactaggtggaaacaagaaaacagacaagagaagtagtgactatgtcgggaatgtgcaatcttcctagatggcctcagcggactttcatttttataccattgacgagaactgtgtcaggtgttcatccacagctgtgaataggacagaaaaatatttttgaatgtgtgggcaaattactgttctagccatatagaaaaaggagagaatgaatattgtgttggcaacagcaatttccacagccaggcgttgtgctggacacttgggataagccgatcagtgaaagcaggcgtgaccaccaactcgtggagttttcacttcttggtagaggcagacaatgtatttcacaaacacatataaaattgcagttgtgaatgtgctgaagtggaggaagtcatgagtccaggatgataaagggggaagtgtcacagacccaatcaggaggttaaggagggcttccttgaggaggtgacactggagctagggtggtgtctcagtcaactttagcatttacagagttcttcttgtaacaaatccagaagtaaagagataactaaagagaattttcctgatactttgaatacacttgtacctcatggctctttgtattgtgaatcgcagaaaatctcattcaaactcaatcaagagaaaaacgcattgactggctaaagttcagcgccctgcttcaggcacagtggcatcaaataatactaacatagtgtcaggaggtgctccacctctctactcagtgtccctctgggttgactccattctcctacaggcttttccatcatggtgtttagatagtggcaatctccagacttgcgtcttttcgtcagtaacacttagaggaaaacaatctactacttccccaagaataaatgttctgcatttggatctctttgtgtgtagcttggaccaggtaccagcccttgttaacaaccacttggtcactagagatgtcattatcttcattaccagtcttcagtcttgtgccctctcttggagcagggggtgaaatcagcacctcccaaactccatgaactgaaaatggggaagagaggccactggcttccctagaagaaagaaaacgcagtcttcagtaaaagtaggactgtttgctgggcaggcagaaagaacaggtgtctgctacagagtagaaataactaataacattaataactgctacagctagcaatagcaataatactaagaacaaacacttattttaaaagtgtttcttattataatttccccataaaaactcattctacattcttggcatgtcaagaatttagccagcctgctttgccatagctacataacccagaagacaaaactagctctgcagtttgaaattagtgagcatgagatttccagagaggaggatttccggtataactaattcccttccctccaccccgaagctcaccttgaatgcaccggtgctcattgattcatgcaaacttgtctctgttattgctgacatgcctggagagggtctgttaagggaagctcatttcaagcacagatggtcccaggtagcttagcctctgcctggtggccagactaagttaattcggacggccttagacttctgatcacatccgtgcagccagagaggaaaagaaaaacttatttatcatcttgataaacagtctctttcaatgtctgtggatgctgtatgtaactcggtagagtcaaatactattaaattgtcatcactgtcaaaagggggagtaataaatttttctacctgagtcatagttaatgacatctacaatgtgcaacacaaatcagaattactgtttgccttcttttctcctaaatgtgtgttttctgatctctctggctgtagatgtgaggcacagccctcaaaatataaataaatatatacttttgttattacctctcagctaaaccaataaaatatccagctgacaagggccagactcttggcttggatgaggtatgcatgcacaggcaaaagctaagcagaagtacctcgttctagttctgcacggaagacatggatttgaaagactgtatttcactgagtgaaggccttggaaatggctccacccaatagttatttgtaaacatatttgcagaagctgcttaaatactgttaagggtgggaggcatctcttttgctgtcatcatcttaaagaataatacagtcatctgtcccataacaatgtttcagttaacgacagacctataagataacatggtataataccatatttttactgtaccttttctatgtctagatagatttagatacacaagtacttattatgttatagctgcctacagtatgcagtacaatagcatgctgtactggtttgtagcctagaagtaataggctatactatctagcctaggtgtgtagtaggctataccatctaggtttgtgtaagtgtcctctatgaattagcacaatgatgaaatcacttaatgacatattcattagaagttaccttgtcattaagtgaggcatgactgtgtagtagactgtatagtacgctttgttaagcttcagcaacaacctccaaatctcatgggcttcaaacagcaaaagtttattgcttgatcatacaacaagccccttgtgatttatcagtgtggctgtgtttgcaggagttactcagggactagatcttctggagcaggcaccgtctaaaacgggttggcaaactggcctgtaggccaaatctggtgcactgtccgatttttatgatccacaagctaaaaatgatcttcacctttgaaatggctggaaattgtgacacataaaaatcacacaaattcaagtttcaatttccataaatattattgacatacagctacactaacttgtttatgtatcatttgaggttgcatttgtgatataacagcgaagtttggtagttgctccagagaccacatggcccacaaagctgaaaatgtttattatctggatgtttatggaaaaagtttgttgatccttgatctgaaataccactggctgccacaccagcaggaagagagccctggaaggtcttgcacaggcaattaaaagcttggcttggtagtgatatgtcaagtctgttaatacccagttgactaaaaacagtcaatgcctcctcctcccacaaggggatcagtaactaccataagcccaggaagagaagacagtcattggcatccctaatggctgctccagctaatactaataatagcaacagcatcagagcaaacacattgctcctgtactcccacactcttccaagtgctttccctgtgtttactcattcatcctcacaacaacctcatgatgaaagtattatagtactattttccccattttacagatgaggagactaagaaaagaaagcttgtatgattttcctgagataaatccagctaataaagggtggaagcagttgaaacccagtcaatgaccccaaaattcaatctcaaacactgtgctctcaaccatcctaccaatcacagacctgctgagatttaaaagaatgccattcattgatgctgtagagacaacttcttcacaaaatcctcaattatggaatatgctagacataagcaaaacactaatttagtgtctgtataacagatttctaaaacatttaacagtttatttaggaggtggttagtaagtggtccatagatgaaagtaaaatctaacatctatggagttgtgggcagttctcctataggaccaaaaaaaagagaaagggctgggtgtggtggctcacgcctataatctcagcactttgggaggccgaagtgggcagatcatgaggtcaggagttcaagacagcctggccaacatagtgaaatcccgtctctactaaaaacagaaaaattagccaggcgtggtggcaggtgcctgtaatcccagctacttgggaggctgaggaaggagggtcgcttgaacccaggaggcagagtttgcagtgagctgagattgtgccactgcactccagcccaggtgacaatgcgagactctgcttcaaaaagaaaaaaaaaaaaaaaggatggctggatttgcagtttgagatcagtttatggctcagcaagaggaccaactgacgggcatctggccctaaagtggacagtattttacagccacttcttccttgagtatctcagattttgttttgatcttttcatcttcacttctaagccaactcaaaaatgttgttccattttttccattggaaaaaaattccaatggcattttcttcatttagctggagaaaagaaatatcataaaatagttatggtttagaagtgatggattcagagtcatcatattgcagtgtctgcttttttgttgttgactgtacctttatatcttcataaaggagtttgtttgtaatcaccacccatgttcgttttaacatccattacacttatctgtgaacaataatggaagaatctcattttaagagaataaaaagaagttaatgattattgttgggcttctttctcagtatgtattcctgcttgtatatcattaaataaatgttataaagaaacatagaacaaaaatgaataaagaggtaggagtagacaagtcaggccaggcacagtggctcaaagctgtaattccagcactttgggaggctgaggtgggaggatcacatgagaatgggaggattgcttgaacctaggagatcgagaccagcgtggtttgtaacctaggagtaataaatagggagtacaaagggagacgcccatctctacaaaaatacaaatcaaaacattagccaagcatagtggcatgttcttgcagttccagctacatgggaggctgaggtgggaggatcagttgagcctgggaggccaaggctgtagtgagctgtgatcatgctactgcactccaacctaggcaatggagtgagactctatctcaaaaaaaaaaaaaaaaaaaaaaaaaaaaaaaaaaaaaaaaagactagacaaagtgagtatgcaatggaaagaacacgttaggccccccaccactgcaggaagagctcagaaatttggggtctttgcaacctggaacctaaaaggcaaatgactccattttccagcatttcagaattctaccctttcatcctcctccagtgttgcctttgaaattgggtttcaatttttatattaataacaaggagaatggcagcccttatttatagtatacctactatgtgctgctcgatttattaattacttttcatatacaatctctaatgcttacagtatccgttaaatttaggcattttgcttacagggacgagggcttagaggttacaacttgctccaaattcatccagctagtaaccaaagtgatgttaattattcaaaattatattagatattagtatattcaatcttttatgtcagtgttttatataattttagaaaaattagtatagccagaggagttattcatataaaatagcatggcctatgtctgttctggaaattgtttccatgtcattctcagccctaaaggatagcactggtgaaggaaagcctaatcaactattgcctagctggttcaatggtcttggtttaagaatagggtcaagggagatccaaaggggatttaagtcaagaatattgcaccctagaatgaacgtaaacatagctatttttctaagccttatttcatttcaattcttgtcctaatcacagtagaatacaacttattcattttagatgttggctcagggaagctgtgattcagtttccagagactaatattgacatccagggtgaatgccccactttgaggaagaaacttccccttcagttgtttcatttctgagattgcattaatttggaatgtattgaaggaaagtctacatcaagcaagcaaatttgaggacagagaatagaaaagtggagatatatcctcagccttattttaacaaaaatttgaaggcagatctaagagtagcccaaaggcagtctgatgtccaatccattacatgagttccctttcctcatgctctctgatgcatccttgttgggagagagtaaacgttccacaatatgtaaagagcagtaaggaatcaagtgtgttcttgtaacctcattggtgcacctttgggtgaaatgtatttccgtgggggtagaccagttgctaaaagttatttctgcagtagagtttcaacatatccaacgtataagccattttcttcttttaaaaattgaagaaatctagtgggtgggtgttgagttgattatggtattaccttacttttagcaattttatttcagggagataatgatgcctaaatgcagtttctccgtgattagcctggaatgagagtagaaaggtaagagtgaggagtagtccatactggtgaaaaaagggaaaaaaataagagttatatttttcccaccaataattctgacctggtcaaagatgataatttcaatagtattaggaatatcagagtaaattttcatgcctactctgaaccaggtattattataatcactttgcctgtatttatttaattcttatacctgataagtataagaattattgcaatccagggcattcaccctggatgtcagtgttagtctctggaaactgaatcacagcatgaatgcccttcagcttccctgagctaacaactaaaataaatacgttgtattctactgtgattaggacaagaattgaaatgaaataaggcttagaaaaatagctataatatgtctactgttcactataggatgcaatattcttgacctaaatcccctttggatatccctcaaccttactcttaaaccaagaccgttgacccagctaggcaataatgtagttcttaaaacaaccctgtaaagttgatgctgtcatccacattctacagatgagaatcttgaaatatagaatggaaaataataggaagcagcagacccaggacttgagtcttggcagcctggctctggaatctgtgatcctatccattatgttaccctgcctcaaacatggttgtcctgcccagaatttcttcctttttcctacttttttcctttacatacccgaggacgctgggagagaaaggatgggaatttgtttaatctcaagcataaacaaatcaagcagctattttgccctcctcaaccaaaacatgcttaaagatccattagtgtctctcttgtcaatgatttacagacaaagacactcagagcttctttccagtccattgggtcaataaagcatttttaacacagtattaaatatgcatttctgacatccactatgatgaattccaaaaaagctacttatacaaccctgatcaaaaagtcctgtaaaagtgactctgaaaaaaatttgcgatttttcttacatattacagcttttaaagaaaggaaccgtttgtaataaagtggaaatgcaaggattctaataatcatgtccatcttaactttctttaaatatggtttattcattttctccaaaagttgtctttggctataagcatatatcctggcctattaatgagaactggggtttactcatagttacttttaattgctatttcattttaaagctatttcacttagagtaaaaagctttacctttgtaagttatgactcgatccccaaccaaaatcccaagttgatttctctagaaggtatattggaagttctcatctttgcaaaagctacacttatcattcaaattcatctttgtgaacatatccacataatggatattcagaaaaggttcccgaaaaaggattaatttatacattctgtctttcttcttctaccgtttccttcctattttccttttctttccctttacattccacatattcttccctccctctctttctttccttccttccttcctttcattattcagtcatttaatcatttagtaaatgtgtgactgcccactattattccaggcacaagagataaagaattaaacaagatgtggtccccctgccagcgtggagtgcccagccaaacaggctagacaacaagcccataattccagttgggagtcaggctgaaaaagaaaagttcagcttgctaagagaacatataatgggggtcaaaagtgagtctttgaggaaaagtttcattcaacaactatttacataccaaacaagtgccagatttcaagcttagtactggaatagtggtaaaacagaaaaaaattgttgtccttcctccttataggaaaagcaagacattattttttaaaaatcaaaatcatgcacactataaatattattgtacaagaattatgtaggagatgtaggctcatacacagtagaatataactcacagtatggttcaggaaggccaccacagcaatacccacacacatgtacatgtacagggcttaggcttatattccctgtctttttatttttgaagcaattctctctattccaatttacactccccccttagcatattttcttctttcccggaaagtctgctgttgtgataatttaaagttgtttggctatgcttgttcttggacacgaaaccactgatagatatggtttggcactatgtccccacccaaatcacatctcgaattgtaatccccacatgtcaagagagggacctagttggaggtgattggatcatgagggtggtttcccccatgctgttctcatgatggtgggggagttcttataaaatctgatgattttaaaagtggtcatttcccctgcactctctctcctgccacatttttaagaaggtacttgctttctcttcacactctactatgattgtaagtttcctgaggcctcccaagtcatgcagaactgtgagtcagttaaacctcttttatttataaattacgcagtctctggtagtatctttatagcagtgtgaaaacagactaatacaatcaccaacagcaaaagatactactgaatgtccaattccctggcagatgaaaaggaccggacattagcaagttcccataggtgtccattcaaaaaatttgacccagtttgtagcccagagtgatccagttggttggtatgagctatttctattaaatatcagatctgggggcaaaccctgacttacaatgccagttgtcaagcttttagtcatctgcctgccagtcattcctaacctcttcttccctttccatcatgacacataattgtcaccagtggggacccttttaaaagaaacattatccttcgcaatttatcttccttatttcctcacttgtacagctcaagacagtgatgcattgagctgggaaggaggcatccattgctaggagcatattggacttggcatttttttaacttctccagctcagagttgctgctgccggaaataatcttgaaatgctatctttttctcttttttggatattagaaactttcttttcctgttaaaaataggtttgataatgtattcagggctctaacaaacccaagagaaaagagcagttgggaaactagagagatgccccatggagtttttttttgcaggggcccttccccttaacaccagggtcaacatgggcaaaaggaatgagaagaaagtccactgttttgaagatttgtggcagaaagagaactgggaagcagagtacatttaacacatctaacttttccagatcggtgtgcattagccagataattacggcatttacttcctagttggaaagaacaatgggatcccttataatgctagatttagggttttgggctaattttatagatattttagatgtatgttttctgcagattaactgataacagaaacaataatctggaaaatctgagtagtacaaacaacctccatactagcctgttctttattctatatcctctgccattagataataggttacttcatctgtcttgttttttagatctacagatcctgggtgaaatccaaaaaagagaccattttccataagcaaaaaaaaaaaaaaaaaaaaaaaaaaaaggaagctgcattttctaaggaagcacctaaatgacttagctttgagaaaccatagatcatcttgaaatcattttgacttggattgagatgaaatttagaaatggataggcattgacaccaaggaaaagtccgaaagatatttgcatgacaaatattatcattctgaaataacattggcagttaagtttgaaaggatagttcacaaggtaaaccttaaaatacaaatacattggattaaaatacacatttcctaatttccagaaaggttgtgacaaacttaactcttccctttcattgggagaaactctgggggaacattttggtttcctttctctttttccaagaagccagctgatggggacaatagataagtaaaacctttttgtctgagggagtcttgaaaaattttatctctgggttataataggaattgtatgtcattttatgtccttatagaatttgatcaccttctcactgtatcatgggtgggcccaagtaaaggtgggctcttgatgtagccaaaaagtaaaaaacacataggaatgtgggacggtgtgtattttacaagcatactatactctgtatatatactctgctataccaaaggcatacacccttcttggttaggttccatattatttgatcatgcaaaaatccatggcagatttgttattcatttttcactttgttcaatcatctacccatctaaatgtaatgtgatatctttgatgggaccctgaaacaggaaagtatattatgtaaaagctaaaagaatctgaataaagcctagcctttagttaataatgtgtcaatcaaatatttgtcatttaatactacctttagatagctgataatcacctaagtatgattgatttcactttttccttagcagaagaatctctgtgaagaatagatcattataccaaattttaaaaatagaatatctcctttcttagagtagaggtaactgagcccccttggataatccataaagtcccacaaaatgtgtctttagagcaaagttatgtaagtgtgacttttcctgccaaagatctaaaaattttacttttttaatacaagcccaggcttccatgggcaggatagactgaaagagtaaattgctccgtttgactgtctgctaggtctgttacaatgtaaactttgggaatgagatttgggtatgatgggacaatcagagcttccaactgttggggtcctgtggggttccactgtgtccaccaagacctatttctgggctctgcaccagtgtacctgagcagcatgtgtgattgaggccatagttcaacttgtcaaaatcaaagagcctgttatttagagcaacaccttcctggcctcatgtgtgtaaatccaccatctgtgagcctaaggaagatatggcctggggtcattgactttatatacaagtctttgatgaaaatggagcatttgtcatttctcagttaccatgctcttcctttttcaaagaaatgacagcatgtacgtcagggtgggacaggggaaagagcactgtatatggggtgagggtctgggttctggtctcaatgctgttggctccttgctaggtaaaacatgggcaagtttcttttttttttcttttgcattttaaatttggatatatattcttttattattattattatactttaagttctagggtatatgtgcacaacgtgcaggtttgttacatatgtatacatgtgccatgttggtgtgctgcacctgttagctcgtcatttacattaggtatatttcctaaggctatccctcccctcaacccccactccacaacaggccccagtgtgtgatgttccccaccctgtgtccaagtgttctcattgttcaattctcacctatgagtgagaacatgctgtgtttggttttatgtccttgtgatagtttgctcagaatgatggtttccagcttcatccatgtccctacaaaggacatgaatgcatccttttttatggctgcatagtattccatggtgtatatgtgccacattttcttaatccagtctatcattggtggacatttggcttggttccaagtctttgttattgtgaatagtgccgcaataaacatacgtgtgcatgtgtctttatagcagcatgatttatagtcctttgggtatatacccagtaaggggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtgtttttgatttgcatttctctgatggccagtgatgatgagcattttttcatgtgtctgttggctacataattgtcttcttttgagaagtgtctgttcatatcctttgcccactttttgatggggttgtttgatttttttcttgtaaatttgtttgagttcattgtagattctggatattagctttgtcagataggtagattgtaaaatttttctcccattctgtaggttgaaacatgggcaagtttctaagtcactcttggtctcatttgcttctcctgtaaaataaagatttgtgatgtgtttattatggtattgggcacataggaaaaactcaataaatgattactttctttaatattattactattaccattggttgcatggctatattgcttgctgtaagtctgtatcatctctagaaaatggaaataacaatagttctatctccatctttcaactactttgaaaattaaatgaaatatgtgttaaaagcacattttaaaccttgataataatatgtgagacattgttgaatacataaaacaataagaatccatgttctggaagagtttgatttccaatgggacacacagacaataatgtcatcagaaaattatatactgtgtttgaaagttacaggtgttgggggcaggggggtgaggggacataaagcaagggagctcatgagtgcttgctaaggggagtatgatttattttaagtagacaggtcaagtgtgcctctgattaagtgacatttgagcaatgatggagtgaggagtgggtgagccagagatctgttgggagcatgtctcaggtgatacagtgaccctcatggggtacatgcctggggtgctcatgcagtaaccgtcaaagtgaccagtgtccatggaggaaagtcaaggagagagagagtcataacaaatcggctgggcacggtggctcacaccagtaatcccagcactctgggaggccgagacgggtggatcacctgaggtcgggagttcgagaccatcctgaccaacatggagaaaccctgtctctactaacaatacaaaaaaattagctgggcatggtggtgcatgcctgtaatcccagctacttgggaggctgaggcaagagaatcacttgaacctgggaagcagaggttgcagtgaactgagatcgcgccattgcactccagcctaggcaacaggagcgaaacgccatatcaaaacaaacaaacaaacaaaacaaataaggtcagagtcacaactaggggaggaggggcggctcggatatttaaccttggtaacctttctaagccaagtgtcaaacattttcttggaagtttttcaaccataaggcacaaccacttgtgaaaagatgcaaaaagcctgagttttgggatctagtgactggggtcacacttatgtgattctgggcaagttatttaacccctctgagcctcagcttctcatgtgtaaagtggggacaataccttgtaaagttgctggaatgtgtataattaatacagcatccagcacccaaatcagagctccagaaatggcattgagctccaagagtagcagagaaccattcctttggctctttgacaacagtgccatgagggacaggctttggaccttcagtgcccaccttgttgtcagtattatttaactcagtgcagtaactcaggcgatctggcttgtctgtcattgtgtccgttgacttgactgtaaatcaaatgagattcaaaatacatcctgagagctttcatgtgccttgtgccattttcaatcataaatattgctccactcttgtattagagccaagaggtgactttaaaattagtggcatttttgtgaagtgtcgaactagctgttactgacttgacggagggtatttgtagctgacaattataagctaaagtgacatgattgcaggtgtctgagttaaagagtgtaatatatgattagccctattccattaacttgaatcccagtgtcgtgcatggggagatagtaaggcactcttccatgaacaagttgcagccttctttcttctagtcattgttttgcacgagccatttatttcttctccttcgctaccttgtacttctccaactcctcctgcatatagcttaccaaggtggttgccctagagaaatacctgtaccacaccagtcctttgttccaaaaattcccattcattgctgtgaggaaacaagtgacaaccttgaccccagtcaagcttacagtttggctggggcacagacatgaacaactaaacacaggaaatgtgtagggtgctaatagaatgaacaaaggtggacgtgaggagcattctctaaggaactgacctttgagttgagctctaaggagagttaactggcaaaatcatttgtgttggagtgaggaggttggagggatgggaggtaggagtgagtattccagaagaaaccatattttcaatccctctaagacagaaaatatgttatttatatctttgttggcaccaaagatataaatttatacctttgttggcacctacaaagatataaataatatctagtcactctggtattcttattataggaagtatatacagactctaccatatgtcaggctcggcactaacccctttacatgtgttctctctgtttatactcacacaaccctgtgatacaggtgttattattattcccattttacagatgaggaaactaaggcattcagtaaatgacagagccgagattcaaactaaaagaggctgatatgaaagcctgaactcttccctcctatggagagaaacataattagtctactcaaaatcagagactcttgcgtttctttcatgttaggccagggtttctcaacaccttcacaatatcgatcttttgagccagatcattctttctatgggaggccatcctgggcattgtgggatgtttaacatagccctgcttcctacctgaaagatgcaagtagctgtgtgctccaaccagtgatgacaatcagaaatatctccaaactggccagctattattatgggggagggagcaacatcacaccccaccaccactgcactgaggatctctgcattacacagttctcagaggacaggatgaaaggatgaagctgtgtcttaagtcttctctccttcctttctccctccttttctttttcacaatgttttctaagtgtccatatgtatcctctatgtacaggagatgtattctcatccatatagtttatcacacagtaatttgaatatagaggttgcttaacaaatgcttggtgaatttttgccaactgcatcctaaatgccaagaatcctaaatggtctgggtctattctgaactccaaatttgatgttgagaaagttgattcctggtttctggtcacttgatgtatcttttgcgtgtctctagagatctgacttagctgatttagctgatttctggggaaagacccacttggatgcttatcagcctttatgcagagccggcagttcacctgctaagatcgtagtggagagtgacatacattagtttgccaataaattctgatgaatgcatggatgagctgttacaattaagtcaagctatatgaccaggactgcaatttgagacattgtttaaagcacctacccattttctccagcaattctttctttcatttgcggatgaagtctagatttgggaaatatgtcccgaatagattttctatttagccccccttgagagtaggcaggcaatggaaggaagagctgatttctgggcagtttttctggcactgtagcttctgtatcactggagtgtcacttgtcaatagaactcagagaatcttaaatgtgatgataacacagaagatggctcccaaaatatgcatttaaatcaggcagcatctttattgggtgtgttagttgcaggcattcattgctttattgcctgtcaatacctacaggccagaattgccacatcttgagggctatccattggtattctttgctggtttggaagtacagcactgtcctctctgtgattacacgtagtagaagagagtcctgttgtaattgtatttcatggaaactgtttctataatttcaattactttcctcaaccccgctacatgcactcccaggggctcgaatagtcactgagttatttctaatcagtgtccctgttctttctctcttgccagaaggagggacgtgtgaagtgatagcagcacaccgatgttgtaacaagaatcgcattgaggagcggtcacaaacagtaaagtgttcctgtctacctggaaaagtggctggaacaacaagaaaccggccttcttgcgtcgatggtaggtacctggttttacctcttgaaaagctcacatggcattcactatacataatataatttcttgttttatctaatatggttccagataatgaacaaggtgcatccgaagtgttagaaagttatacaattgccagcctcagcagagtttgaattcttttttctctggtgctattatttgaatgttttttccccaaaaaatagatgttgaaatttgcttgccattgcagcattgagaggtgggacctttgagaggtgactgggctgtgagcaactgtattagtccattctcacactgctataaggaaaaacctgagactgggtaatttataaagaaaagaggcttaattggctcctggatgcacaggctgtacaggaagcatggctacggaggccccaggaaactttcaatcacaggagaaagtgaaggagaagcaagcaagtcttacatggccaggaaaggaggaagagagccaagggggaggtactacacaattttaaacaaccagatcttgtgagaactctctcactatcataagaacagcaagggggaagtctgcctccatgagccagtcacctctcaccaggcccctgttccaacactgggggttacaatttgacatttttttcaggtcaagaaacatgaaggtccagctcatttgggaaatgattttggactgaggctctagagaatgatgatggtgataatgataataaatattttcatgcgcatccgtgtgaagataccaccaaacaggctttgtgtgagcaataaagcttttaatcacctgggtgcaggtgggccgagtcccaaaagatagtcagcaaagggagataagggtggggccgttttataggatttgggtagaaaaaggaaaattacagtcaaaggggagttgttctctggtgggcagagtgggggtcgcaaggtgctcagtgggggagctttttgagccaggatgagccaggaaaaggactttcacaaggtaatgtcgtcacttaagggaaggaccggccattttcacttcttttgtggtggaatatcatcagttaaggcaaggaccggccatttacacttcttttgtggtggaatgtcatcagttaaggcggagcagggcatattcacttcttttgtgattcttcagttacttcaggccatctgggtgtgtacgtgcaagtcacaggggatgtgatggcttggcttgggctcgggctcagaggcctgacaaatataacaatacctaacattcattcaacacatatttaatgagcacttactgtattccagataccactctgggtgctccagaaaaactgatgaacaaacagaattgtcctgagtcctcagtatggatcaaaccctgtgctaaacacttctcatgcattattttatttaatcctcccaacaattctacaaagcagtatattttttctctattgtgatataacaaatcccaaaacttagcagcttaaaacagaaaacattatgtcacagtttctgtgtgtcacgaattaaacttacgaggttctggcttagagtatctcatgtggttgcagtcaagatctgaaggtttgactgatatggcagaatggttttaagatggcttgttcacatggctgttgggaggtggtcttgtttcctcgcctcgtgaacctctcaaaaaaaacttgatgtcctcacaacgtggtagctggcttccctcaaagtgagtaatccaataaaacaatacagaagcctttatatgtcacctcagaaagttactcttttttatttccacaatatcctacaggttatacccactagcccctattcattgtggtggtagaccgcaagggctggaagaccagcagtcagggatcattgtggggcaccatggaagctggttaccataaggagatacatttttatctaccattttcaacatgtagaaaccgaggcttggaagggttgaatagtgttccattcatcctatggttgataagccctggcttgaatgactcttcagcccagcataatggactctaataccaaatttagaccaccacctttaagacaattttatatgttactgtcaaacaatgagtccaaggcgcaaagggactataaatctctcctcccatctttatgtttcataatttagagctgggtgtaagttgattttcaaatcctttatttaagaaatcaggaggaggactcaaagaaatgagtcacttgcttggttcacataacaggacactgaacctgaatcccttggcttggtgttcattgttcttcctctagatatagataaggaaggacaacctctagatcgattcatgttatgtattttcattgtgggtcagtaggtggttagaaagagaaacacactcaagctaggctaagtaaagaggaagtattttaagaaaataaaggaatcgcggtgaaccaattaaaggaaattcagccaaacctcgtggaattcgtaaattcttcaggcagctgtcatctcattttctttgttcacggaacatactatctctgatctcgtttacctagttctctcctatgtagactgtctctcttcaagatttttatttttaccttctcataaattagagaatgatataaggcttttactttcatggtactgattctaatctctctcagcatgattgtattgcttcagggcatgaatatatttgactcagtttctgtgtcttaatacattatctgagaagaaaagatgtgattggcccagcttaggccagtgtgtcaacctttgcccagctagtcacagccagaggagcaagcttatgtggcatatacagctgtcaattatatgccatgggaaggtcaagctattttatttttattttttagagacaggatcttgctctgtcacccaggtggtgtgccatggcaccatcatagcttactgcagcctcaaactgccaggttcaagcaaccattctccctcaacctaatttttcttttattttccgtaaagatgaggtcgtgctacatagcctaggcttgtctcaaactcctgggctcaagcaaccctcctgcccaggcctaccaaggtgctaggattacaggcatgagccaccacacctggccaggtcaaactgttttttaaaggatgttaaaaagtcaagtttggggatatactgggactagttctcaactggggcaatttctcccagggatcatttggtaatgtctggagatatttgggtctacccatttgtcacaacaagggagctgctactgatacctagtgggtagaggccatgaatcctattgaacatcctgcaatgcccaggacaacccctgcgcccccgaatccccacaacgaagaattctcgagctcaaaatgtcaatggtgctgaggttgaaaaactagcactatgattatttacttactctacactacagtcaacacagtgagcacctctaatgcagggaaggcaggcagttagatgagtaaagctatttccctctctcttaaagaagaaactcttggccctagaagccaataagcattataaaacaaaaccatgatggtttctcatgttctttgccaaagaaagccttgaagccgttaactataaatcttcattttgtttccagttcatttttatctctaatgatctagaaatagaattgcctttaggatttggatacaaaacacaaagtgcaatgcattgcttatgctgacagagggggaaatggtatctagccctaagatttgtaagaagttaagccacataacagtaatatttttatctcaggaaaactttgttcgactttgggaactctgaaccctttggtgtggttggttcaaacaaaagggctatcctttctgcattccaggcaaaagtcaataaagtattgagtgttctttattctcatgttgattatttatatttttggtaacattctactccaaaatccttcaatccattggcatgtatgggcaagtctattgtgttgctatgatcaaaattgttttggtggcctagatctctaaatgaaaattaaatataaagtgtgactataaattaaaatttcagtatagttattcacatcatggagtgagaaatttcatatacctggatggaatcgcagctgtacctattactgatagaatgacatttttgatagaatgacatttgctttctaacctcagcttcctcgtctttatttttgatagaatgacatttgcttcctaagctcagtttgctcatctgtaaaatagggattatagacatttctactttttaagattgtgctgatttttttaagatttaagaaaatcttctatataatgttttttgcacaatgtctgactcccttcagaggctcactaaatgataatatctgttttctatctcactagtaaatgtggataatgcttagagagaaactttttttatgagttttgtttcatattaattgaacacggtggaattttagccatcatcttttcttagaaatgcttccaactaattatcctggatattactaatactggtaagtcatcttcaggaatgcatgtttataataggaattttgaaaatttcagagatacatccatgcactaaaatcacccatgatatcattgcccagggactattactacattgtaagataacatattaatatatgtccttccagtcttaccccactactaaaaagcaaactcacattgtaggtattttattgaactaaaatgctgtagcaaagttttatggatggcttgtttcacttaatatatgatgaccatttcccaagtgaatacatattcttcaaaaacttattgttaatagctatatgggtttttcagaggtggatacaccaccatttatttaactatcctctccactttatggcatttacagagtttcttgcattcccaatctcagttccctaggaatagacaggcatcaacttctctgcgtgacagcagttgatagtttatacaccacgtttgtcctaaacatattctgtcttatgcagtgaatttcccatggtaagtgttccaattgctcttatttgccttcctctgaaatttcaggtcagttgccttttacagtgttttcaaaaacaagagaatagctatcattttaaaagaagcatatattggattgctttaaggttgagaatctgagagcagattatttaaaatggaacagaaaatgtggggtaaaaccttagcagcttattcaagagtataatatatatttggagaaaattttaagtggtgatcttttatttcaaaaatgatattctattttctaataattgaaaacaccaaattacacacttgccaaattaagttatgaagtagtcatttataaatacttataaaagcattatatccttgaacctgtgcctagcactattctgaaggaatgtaagtcattataccctaattagtaattaatctataacccaaaatggaagtggggagcatgctactcaatatctttagttgagaacaactaaaaatattacctacagcctttcattaatttccaagttcttctcggggactaaaagttaaaatcaaataaagattcataaacaagaggttgatgactcaaaacacacctatttatttgagaacaatttttccaagcaaatgatttaaaacaaacaaaaataaatttctggagggcttatgaagttacgttctatgattctgattaatctacaatggcatgaaaatagtatcgatctcaaagttgtaaaaataatggaacataattaataccagtaataataataaaaataatgtttaccattttttaaggctattatgtgctactgtcccaactactctaagtctatacacttatttaattctaactctaaccctataaggtatgtcctcccattatttccattttattcgccaggaaactgaggatcagcgaaatttggtgactgactcaaaaatcacatagccagtcatggcatagccagaaggtcagcctgggctgtcttcagggctcatcattcatcaagcataggcaaactcttaactgacatgaacacaagttatattccaagggcattcttataagatgcaaaatatctgggtgagagggaagtaaaaccaaccatgtggatacttacagaaacacccagttcattgggcaatacctgccccttttttttctacatcataaagatgattgcactttcattgttatggagcaattagaagcagttctttcagtgcttttatttttatagaatgattgaagcttcattgtttaaggcatagtgggagtggtaaaattttcgtgcagttttctctatttaggattttgttgtcttgtaatttttatctgtttctaacatggacaaatatggggggtggggggcatttaactagttgttagtaggggaggtcctttaatcccttgtggattttagcatcactgtaattaagaaaaaaatctctatgataagttcagaagtctttcttctcattccatgtaaattatgaccatttggatgactgattactagcaaccttcacctggtgttcttgccgtcttatactggatcaccagcaagagaaagtgttaacaaaaaggccaggttacatcagaaaactttctttcacggcagtgaaaacccaagtttaaaacaaaacaaaacaaacaaataaaaaaaccctttagttaatacaatgaaaaagtcatcctgctatttctgtgaagaaacaaaacttacaacgtaacagaacattttgctcctggctcatcatacttagtccccaagataagtgcaaatgagacagagaagacatacataaagacttcgacccaggaaaacagactgacagagaagatgagacagaccagacagtgagagaaagaaacatacaaagcatatgagaaagagagggtcagagattaagggtagtaaaagagagtagttaataaagaaatgcttagaaggaacattaatacatctatccataaaatggcttgattcattttccccaagaactgtttgtattcagtcttacagtttataactattttttaacaaaataaaatttgacagatgtaactttaatttttttttcaagtggcattatatgagattctagaacaagaacttctgcaaaaattccttctggtgattgctcctgggaaaaagtcatgatacaattttcttgaccacataccatcatatttcctagagacagccatggtagagaaaaaggtttgataattgaaggaagtttgaaattcagcaacagtttttcataggataacatgagatatatgtgagaaggattatgtatgatagcctctgcttagccttccaaaacatgacagtgtattaaaggctctgagaaattctgtagacaagtagcttattaaacttgaacacaatatttcccaaactttttagaacctttttaactgtaacatttatttgtctcctctagtccccagaattccatgcaatagacttggggccatgatgctgtagagtctgtggactatgatttgttttttaggaatgtctttcaagtcttccgagttaatggatagtgtgatgcccgaagatagctaagtgttgcctaagactggctggccagagagtacacaactgatcctatactgatgtgatttatagtatctcagtgacatgtcgggctcaactgcagcttggaaatcatctagagagcttccagagcaagcctagtatgaaaaaccctaagcccctatttatattcacaaatattaaacgtttttggggacagagaagatgacctattttggttctgccatttgttacttgtcatccacacacgatgaaatactgagataatgaattgctgtggtggatcagggatgcatgccacaaaggctggctgtggttccttcattactgtctctgtttgaaacttgctttgttctttttaaacacaccaaagcttgtttagtagatggaatgctgaacgcatttgactttatcagaagacatttataaagggaaattcgattgttcttattagaagaggatcttgcataacatctttagtgaagtgatggcattttcaggcatgctttctgaatcttatgcaaatcctccttgaaacagcatttagtccccaacttggcacctaagcatgtacaggtgtgtgagagatgcaagtctgcattcataagaggaatgagaggatgaatgtacaagaactgtcaaagctttttatactgcctaataaaagataggtgtctacgtttgttcctcctaataaagacagctggaattcagtcatcatatgtatctatctaatagcagatgttgtcatctttctgtttgtttgtttgttttctagtttagagcagcagttgccagtttccagcccactggcaaaaaccattctcagacctgttcctgaggtcagcagagtattgaaaaaattgactttgcatgcctttaaatgggacactccagtttcccacaaggctcactctttcttattattgcactaggctctgacaggttgatgttcctgcctggtccttaaaggcaatggaatatgtggtaacaagctcatacagtcgtttcctactaatttcaagtgaataaactaattttgaatgaattattttttctaaaaaattaattttgtagaaaaaatatactctttaatcaaagtaatatatataatctgttgtgaatataaaagtatgcatatattccataatagaaatatacatcaaaacatcacattgtaccccgtaattatttatcaattaaaaatttttacaaaagaaatgtatctgtataaacctaacaaagaaaggataaaaattaaagtaattcttcatttttttctttctcactaatcctctcacatcataattgccagaggaaattatccttgtcatatttctacacatccttacagaaaaatatttgggtacatgcaggcctacaggtatagacatataaaactttataaataaaaatgatattatattgtacagactgctctgaacctaaattttttagcgcagggaaataagtagttcactgaaagaaataaaaatggctggtaaacatggaaaaaatgcttaccgtcactcacatgaagaaatgtaaattaaacactgaactacagtgtttcatcaatcaaataggcagagatgaaaagtttggtaatatccagacttaaggaagaaagacaaaaaaattacatttaaatcatactcggtgataaacggcttacaaactcaattagttagccactcttctctatggggttcaccaacaaagaagatgataaataggaaattttgtgatgagactggctgtttcgggtacataatacaaattatgtgcattataattgcaatgactttagcaacatctcttgaatgtttaattctctgcattttctcaacaggatcagattcatgactgtgggtatcatctaagaaatatttcaagaattttgatgttattttaatgtgaaaactatacataaaattagatttaatgcgtatacttggattaatgtagcaagtctcattgtaaagcccatctatatagccacttaagagaagcaaaattctctgtataaacatctgtcatgatgtgtatgtcatgtgtgtgagagagagagataggtcatggcacagcacacccaaaatccttgtcagttacctaactgccataaacttgtttacacataacctcaaattcacaaagaaatttccccaaagtagcccccaagtcattggttttcatttatctctagagagctcaggtgttttcaaagaactggtcttctctgatatgatagcacttttcatcctttctttttccagaaagtgggaaaaatgttgttctaaatctaaggagtcagctcctcatctctttagctgggcttcagcctagataaggcaggattctagggtcctgtgttattaatgtgctgtccacatgaataactagcaaatcttgtgaattatttcacacttctaggaaaatctataaccctgtccttctgcaacaacactggaagctgccaaggatactggtacattgctatgtggaaaaatctgataactttatataaggaagtagtaaaacttgtatccccttctgggacctgtatataaacttatacagatgagtaatattttaaaaaattaatgatatatatgttcctccatcctctgaagctccttgaatttttgaaaacctaccaccccccccatacaagttcaaacaacaagatatgaattacccattgataaagtttggctgtgtccccacccaaatctcatcttgaattatagctcccataatccccacatgtcatgggagggacccagttggaggtaactgaataatgggggcaggttttcccatgctgttcttgtgatagtgaataagtctcatgagatctgatggttttataaagggcaattcccctgcatatgttctcttgctgccaccatgtaatttgtgccattgctcctcttttgccttctgccaggattatgagccatcctcagccatgtgaaactatgagtccattatacctctttcatttatacattacccagtcttgggtatttctttataggactatgaaaatggactaatgcacccactaaccggagcagagatgcccaaacatgtggagtttaaattcaaaacctgttaaggtattcagatttaaaattgaagaatgagtattttcctgttacccatactgttgagagcagagggagaggaggaaggaaggaccacatgggtagcaggaatgtggcctactagagtaaaggccatctgtgactagtaccagagagatgtgactttatctaaagatccatatctccagcctccagccaagagaacactgtacttgacagctcactacactttgttccagccattttattagctgccttcaagtgaagaccatccattaacagcagctagatattgcacattgattttccaacaaaagtcataaacacaggcatccttcgacctccttagcctcctaccctgcataggtgacccccaggaaacgagaggagaaacctgggttcctagatgggtggagtagtcataggaaggaaatcttatgcaccaactctgtaagaacagatgggtttgagatcaccaactgacctaagacattggtggaacactctcaccctccccatttcacctgtttcgtttatgaaatgaaaagcaagtccaataatatctgatattacttggtattttcattattgcatcattttaataattgagggtaaaatttattggactatcaatttatattacttaggcttataaaatgattgggcaattaactagacactcattcaaaggaaggtcacatcctttaaatttagagtgacctgtacatgctaacttagaagtcgtcattcatggtctcctttggtgcctatgcactaattttgctttatgccagatgcctcttctcatcaatgtctcccgggtacaagaaacctaaacctttctcaatagaggttcaagtaaaaagggaagttattgtgagaatatacttggggtcatggaattcaagagcagagattgattgctctacagcatgccttgaggcacctgaaactgaaatactgatttcagcaggcagcccatttgtgttccccatagctctttctcatgggagatgttgcctttcatcttgggctcattctggatatttgccttgttctcttttctttacaaaccagggaggttaagtctgtccatgtcacctggcaatgatcttctcaactaaatggaacactacttagagtagtaggctaaaactggtaattttactggtttgtagttactgagttcttactgtgtgccagactctgtgtattgaatttattacttatatcatccttataatagccttataagataggtactattattcccactttacaagggaagaacctgatgccttagagaagttagatcattccttccaggacatggtagggatagacatgggaccccatgtgggaactgctggaaataatgggcagaagacaggatcagaagcaagggtaggaaagattcagagtaccagttcacttcttatatttgctctctaggagaacaataacaccagtcacactagcctcctgattaagctcttccttcaacatacacaccatcatcattcatgttccatatgtttacattccaaattcatccatttctcctcattcccgaatttcaagactgccattatctagactcatatctcaacacttgttaatccatctgattgaaatgcatcctcaaaaccccttcttcataccatctgactcttcattactcaacttagatcatcaattccagaggtccttcctgaagccgctatgcctaagttaataatgcccacctgtgagtccttggaacagcctgtataacatttctcataactcactgtaatgtactataatctttgttgacttgttatctcctttgctagagagacttactcactcattcattcattcagcaattatttttggagtattgactatgtgccaggaattatgccaaatacttaatcacataatgctgaacaaagacagccccttgctgtcatggaacctacagtccagcaggagagacagaccatgatctaatcatacctaaacatatacaagtaaaccacacattcagaaggaaaagaattctgtccttggagaggattcaataatgaggaatataaaggagattggggaactaagaagacttccgtgaagacgtgacaggaagcctgaaatgtgaggtacagctcaagctagtgggtgagcagcattgcaggcatagaagagagcatgcagaaaagccatgggttttaatcaaaaagttgagagaaagccatggtggtggaagcccataggacaatgaaattgcatgagacagaaggctgaaaagttagatacggccaaacaagaagtaacaataaatagtgtagtaattaagctgtgtgtctctattacgtaacatagttcttaaaactgagtcatgctaatcatgtacttagagggggcaataaaggaatctgcagtgggaaattgcgtaaattagtcaacttagaattttgtgagtgaggagacagtattgagagccctctatagagacaaacatctcctatgaagtgtctgacaacagatttcaaaacctctatactaacacttcagacaatgccaaagcaaagcaagtcaaattgtctttttgatactaccagcctccacacatgttgttacccacacagggttgctgtcacctgaatgtctcattcactctctactcccaaccgctcacactgctacaaagagtcttcacaactgcacacacacagcaaacaaacaaaacttttggatggaaattttaaatcactgttcttttcaattctgcttactgtctgaagcagtcttaagatactgtattaactaagagattctttatacaggggaagcgcatctgggtaaacggcttctcatttggggtttattttaactacaggctcatgtcaatttatttttctcctgattggcacttaagttattcaactctaatttatttctttatggattgacaacaccatgttgtatgtagctccctccctaaccccctacaaaagcctctataacacctataccaaaggacgcctgaccagccttccatgaaatctggggtagtatagtgttgtaaaaattcaaatgcaggtgttataagtctattttgtgaagaaagagatgatggagaaatggctgtttctcacattaccaagtcctgctccctttaaaatcttcaagcacataagtttgagaaacaatgtaataaaaccacattcacactatagaaattacctattgcccttagcagcccttatgcaagaattataacaactacagggactgagcgttgttgaggactgacactgtgtctcatatcctactgaaaatgttaccaacattatgatacctaatcttcataacaatgcatgagatgggtactattgttattatccccattttaatgataaggaaactggggctcaagatgataaggggcttgcccagggtcacatagctaccaggttggagagtcaagattcaacctcagcaatctgatagtattactcatgaaagatattaagattgcattcattctcaaacagacaaatggaaatttgttatgggaatatagaaacactgtgacttggaacacacagaggcttgaatttcaaccctaattctgccactgattagtcacgttgtagcaggatgagtcgcagacaaaactcctcagacaccaaattaaagaaggaagaagttttttatttggctgggagcgtcggcagactcacgtcttaagagccgagctccccgaaaaagaaattcctagcccttttaagggcttacaactctaaggggtccacgtgaaagggtcataatagatcaagtaagcgtgaggaacatgactgggggctacatacatcagctaacaaaacaaaaagttttacaatgctttctcatacaatgtctggaatttacaggtaacaccagtagttttggtcaggggttaatattattattattattttaaccaccagggccggatggtggtgccaaggtcatctagctatttatcttacctctgttgctttccaactttttgctttctcccttttctcctgtcttataaactagggaaaaggggaggttggggagaagctgggaaggacaacaggagaagtggtggtctcatttcataacgtgtccttaaacgtattaccctcttggaaccacagtctctttttctataaaaaggaaatgaaaagaatatagcatggaagagttgaagggaatattaaacaagaaaattcatataaaccacaaatgcgtaatccaatctccatgcatattgtgagccctcaattatattagcaataatgcactcagaaaatatattaaatttatattttcattaataagtgcatttctagagcttaagataagaaatcatgcaattttgattgtaatgcctttgcttgtgcaccttttcctcatttgattacctccaaccataaaacaagactttcaagtctccagaaatgtgtgcagagaaacaaaaagaagctggtcatgacatagaaaagtctgtatcccatcaggcatgataagaggagacaagttgaacgcgacatgccgtgttttcatgcagaagtgaaggtactgaggacatcttctaatcccagtccaagtaagagaagacactcattttccaagctcccattggtactcacagtacctctggaaatgaaatatctcatatgcatgatggaattaaggaactaggagtgtgcatttcactgaagatggggcacattaggtacaggttgacttacccctgactttggtcttctcttagccctcacacgagagctgcctttctcttctcactatagagactccctaggttacttcattcattctcatggcttcagagacccaaatagctcccaagtctatgcacctagcctaatccgttcttccaaactctaggtcattttgttcatgtagttattagacatctccgtttggatttctcaaagacacctcaaattcaatatgctgaaaatggagcacacatttccaccagtctgcttacttgagcatggtttcagcatcactcaatagcatttgcatttactctttattcaagccagcctcttgggaaacatctttgcctttcttcacttcctcatggcccatgtccattttgtcatcagaactccttagttcctctgactaattctctttcatcttttcccttctttccatctcaatttctatccaataaccaagctgaagccattatcaccttttcaccttgattactgaaggatcttcattcttattgcctgaagtctttatcatacacagcctccaaaaactaatctaagtcctcctgttgttggctactgtacatcttgttcttccctctttggaacacaaattcccactttaaattacattttaatactatctttatttctgtacaacaaatgctgcatgaaggcaaagttcatgaaggtcttgttcacagctgcatgccagtgcccagcacaatgactggtacagatgctcaaataattcatgtcttttgtacttatgtagtgggacaagatcaaatcaaagatggatttatgttccaattccagctctactataatcctaaatttaagttcccaaatctgaaaacaggaattacaagaacttaacttcacaatgtaatttgagaattatataagaaatgcatgtagagcacttagcacagaattagttctgaataagtattagttctaacaattgaaaggattgatgtgagatacagatttggtgggccatctcttgaacacttcactgttaaagtggagaaattaagacagcacaggaacaattcccagacttacacttgagcattgtttatgtgtaaaggacattcttttgtcctgagtgtatcacagactcaattgactatctctaccctaagttttctgtaaaaggatatcagagaaaagttgaagtcttgtacttggtggaaccagtcaaaaacctgatgtttttaatgttatagaggctacaataatctctatcaacaaaactgaattggcagtgaactcttctaagcatttgtatcgtctgaaatcaataaacttaagtttttatgttgttttacttttgagttgctagtgttatgtgaagtggtaacttgagattggtgtggactaagtttttgcagcaattaaaggactgttccgaggaaggctcaacaatttcctctgtacttctttctgtctaaatacagcctcttctagcaatgagcttgttacaagcagtagaagaaaatgtaaatattttcttggctgctatttacaagaaactgaatataaacagattcaaccatagaaccttattagataccatacctaagatgtctgttttacagtacattgaagagcttttgcccccttctttgtgttcatgtgctgtgaatttttttcttccattttgatacaaaaataaagaagacctcaagcagaaatttgttctatctatgactttttctaatattcctggaaggcacaaaacatgtatcaggatgaatttacacataacttgtgaccaaaggtagaattactcaatatactacatgattattctgatgggaaaacactacaaatggcttttccagcctgctgactgactgacagaatttggtatacatttcagagttaacaccatgtgtctaaaactagtcatttttgcggacttcattttgcattgtctgtggaattcaagagaaacatgtctaatactacctcctgtcgaaaccaaaaatgatacatgaaaggcccaagaaaatgccaaatcagaagattcattctgcaaatacttactaacactctctaatactgagcatcagatagagtgaccaataggacatgatttctgcttcaatgattataaagttcaggggagatgacaggcaaattggtgattgcaaagttgtgtgatgtgtgctctgatggagatgagcccagagtgctctgagagcagaggttagggtgttaaatgatggaagcaggagggtgttctagatggcttctcatcagaactaacatccagtctgggactctaagtgactaggtaagaggatgggatcgaatgtccatggcagaaacaatggcatgtgcaaaagcccagcatcaacaagaaggatcctaatgaatccaaggagctgcaagaagttcaatgtgcctgggtagagaagggtgtgggatgggtctggaaagaagtgagactggaaatctcattaggaatgagctcatgcagcagcctggtagccatggtggatattgaaactgcccaagagcagtggaatcaggcactaaagggttttgtgtcaatgaatgttatggttagatctgtgtttggatgtctcactacatagcacaggaattaaattgtttctagtataattgctattcattgtacttagagcccaaatttctaaccaatacagagaataaacccaagaaatgtcagaaaggaaacaggtccattctgatttttaggtcaatgctctgatatttagggtaacaaagttacatcacagttttgctggcaaaaactagagtggagattatgaaagaagtagtatctccaataggaaatcttggcatcttagccacatgactgtgaatgcatgcttttggttttgcatcaaggatcactatggcaaggggagtgttcattctacttatgcagaaaaagtaagaaggactgagaataacatatcttaaccatgtaaaaacaggcccttcatataagggaaattaaagagtacgattaacgtcctgccagactacatgttagaatcacctagggaggttttttaaaatatcagtggcttggccacacccctagatatttttacttgattgagctgaagcagggtctagacatttgcattttttaaaagctccatgagggatactaagggataaccagagttgagaaccaaagctgtagtggttaagagcacgggctggggaataaggtagaatggattgaaattctggctcttgctgaaaacaaaattatttctgttcttttaatttctaatttataaatcttccatgtggcattaaaggtgacttatatagatatttccatcacaaccagataaagtgtaatgtagacatgaaaggaattcaactcttatgccctgcccttagtttcttcatttgtaaggtgggcataacagtatctaccttatatgatctacgcaagctttgaacatgttaataagtaaaaagatttataagtacctggcatataagtgtttgatagatgtaagctattgttcttaactcaggtgaagttcataggagaaacaggacagagaggagagaaatcacaaagcatgtttcaaagacaccaattagtttggctgaggcctcagggagtaataggtaaaaaacttacaaagtcaagttggggccaaatttctttcttgagctccaggctaatgttgaaatttcagcaagtgttcattaattggtcatctaataatgtagtccccaagcaggtaagaccagcaggtgtatattgtacaaaatagaataaatttaaggattgctcagagttcattccaaaacttgggctctgatttgaattgaacccaaatgtggaaccaacagatgtctctgtggaaagttgtgattaagtcaacatagagcttcacaaatgaacagcgagtcactggttatgaataacccctggcactcaggaaggcagatgcctttcctggtgacaccttggctcttgttaacagatacagccagctccacttctgttgtccagattttgcccactttattagaaaactctaaatagtgctgaaaactgtttctgttctttctctttttatttataaatattttataaaagagcaaatgtaacttacatggacaaatcccacacagcaatgtaaacataaaatgtaatatagacatgaaagaagtaagaagacaggggaaatgaggatgagatgtttaaaagaaagctgggagggaactgagagaaggtcacgcaatcctataaatatgccaccaatgcatcgcaagtttggctgtaagccttctaacaggcaatgcaaagagggaaacaagattggttacaagatttagaatgttcccagcttaatccaggctgttgcttaatagcacaataacattgtgctattcttggcacaatgttaaagagaaatatgtccaggtctacataaagagaatatagtttaaaatagttgtattagtccattttcttatggactttcttatggtccattctcttatgttgcttgtaagagaatatctgcatctggttaatttataaataaaattatttcttacagttctgaaggctgacaagcctaaggccaaagggctgcatctcgtaagggccttcttcctaggagtgactctgtaaagtcccaaggcaacacagggcataacatggcaaggggacggaatatgccacctcaattctctctttctcttcttataaagccaccagtttcactctcatgaaaacccatgaatccattaaggaattcattcattaagaaatgaattcattgataagggcagagtccttatgacccaattaccccttaaaggccccacctgtcaatattgccacactggggattaagttttaacataagttttggagggtacaaattttcaaaccatagcattctacccctggcctcccgaaactcatatccttctcgcatacaaatatattcatttcaaccccatagccctaaagtcttaacttgttctagcaccaactcaaaagtccgtctacttttttgtgaaatcaaaacaaggcatctacttccaagacacacggtgggagagacatagggtacacattcccattccaaaatggagaaataggctagaagaaaggagtaacaggccccaagcaagtccaaaacccaagagcagacattaagtaataagactccagattagccatgtgcagtggctcatgcctgtaatacaagcactttgggagatggagctgggcagattgcttgagcccaggagtttgagaccagcctgagcaacagacaaaaccctgtctctactaaaaatacaaaaattcattgggtctggtggcacatgtcaatagccccaactacttgggaggctaaggtggaagttttgcttgagcccagagtgggaggttacagtgagccaggattgtatcactgcactccagcccaggaaacagagtgagaccttgtctcagaaaaaaagactccagaataacagaatagtctcctctggctccatatctgcattttctgcacaccagttgtggttgggcccccaaggccttgggcagtccaacccctgtggcttggctggactcagtctacccagctcacttagggttgcattgcacactgttctctctacagttatggggtcttggtgttagtcccactcccatggctccattaggcattgttctggtggggactccctggagcaccttcaacgcacctttccactcagcattgctctagaggaagttctctgtggtggctccaccccagtgataagtctctgccttgccctcaggttgtctgacacattctttgaaatctaggtgaaggctgccatgcttccatagctcttgttttctgcaagcctgcagaattagcaccactttggtgacaccaaagtttatggcttgcatcttctggggagtgggtttcatctcaattaaggccacttgagccacagctaggatggccacacattgctgtaccagggttctgggagcaaagtgtcgtggtatccctgagcagcaagcccatgtagagagtgtcaggcctgtcccctgaaatcattctgccttcctagccccctgggcctgtgatgggagcagcagcctcaaagatctataaaatgcctttgggatctttcttccattgtcttatggaataatacttggctcccttctatccatgctaatctctttaggaaacagtcactgggctacaccattggtttttctctcctgaacatgctttttcactttttacatggccaggctgagagttttccaaatctttctactcttctttctttttatttataaattctgtcttcaaattattcttttcctcccaaatctcagtgtaagtggacaaatgtgaccatgaaacgtctatattttgcatagaaatttcttctgccacataccctagtatatcactcttgagtttggccttctacaaagctgtattagtcagggttctctagagggacagaagtaatagaatatatatacatacatatatatatatatatatatatatatatatatgagtttatcaaggagtattaactcacacaatcacaaggccttacaacaggccatctgcaggccgaggagctaggaagccagtctgagtcccaaagctgaagaacttggaatccgatgtttgagggcaggaagtatacagcatgggagaaagatgtaggctggaaggctaaaccagtctagtcttctcaggttcttctgcctgcttttattctggctgtgctggtagctgattacattgtgaatgcccagattaagggtgggtctgcctttcccagcccactgactcaaatgttaatctcctttggcaacaccctgatagacacacccgggatcgatactttgcatccttcaatccaatcaagatgacactcagtattaacaatcacaagtccattccttgtcaacttgaatgcatatacaactcctgagatcatacataatcttcaaataaagacaataataagatcataattatgcctaacataatacaacttcctttgaacaactggaactgcaccaatccccaactcaaatgctattacataaagttaacaacacttaaatgccaatatgaaattgatatggtttagctgtgtcccccccctccaaatctcatctcaaattgtaacccccacaattcccacatggcatgggagaaactgggtgggaggtgattgagttatgggggcagatctttcctgcactgttctcatgatagtgaatgagtctcaaaagagctgatggctttaaaaacagaagtttccctgcacgaactctcttctattgtctgtcaccatgtgaaacatgcctttcacctcccaccatgattgtgaggcctccccagccacacagaactgtaagtccattaaacctctttcttttgtaaattgcccaatcttggatatgtctttatcagcagcatgaaaatggactaatacagaagtcaataaattttagggcacatgataaaggaaaaaggaaacaaaatgaagattttttatagcacaagtgtatacatgcacaaacatgtttttaacaaaaggaggaggaaatatgacaattacagccctcgtttctgcaactggtcacgtggtcatagctggtattaatgactagtttcttctactacccattctgtattccctttgccttcagcaaatgcctcaagaggtcatgaatttttcctggtagagtgacccaaaccttcattcctgaagggtctgggccatttgtagtcctgcctggattggactgttgtagtttcccattgaccttagtcacagggaatggtaatactaagatctcttgtattccacacatactcttccttacctccattgtggaatagtagactgattttatcttgataatacaggtcagtcaccgcagccaacactgtaacccccttcttagcctgttgacttaaaggtagaggagcccaaagtgtccaggtggcaatcttaacttccaatttaatggaatcattgttgtgtctcctggtggcagtgttcctccctctggaactatatctgactaaaattaagggatcttctacctcagtaaaatttctaggggtccagtggtgttgggtctgtcgagatattctttctaaggtaaagaataagttgctgcatttggccacccctacaaccaagaaagaaacacaaggcctagtgggcctatttggattttggaggaaacatattcctcatttgggtgtgttactctagtccatttatcaagtgacctgaaagactgccggttttgagtgaggtccagaacaagagaaggctctgcaacaggtgcaggctgctttgtaagctgctctgccacttgggctatatgacccagcagatccaatggtgcttgaggtgtcagtggcagatagtgacactgtgtggagcctctggcaagcccccataggtgaatcacaacaaaggcctctaagattttagagcaaagccctgccatcttctgcagattactactctccttttgagagatagctcttggcctgttactgggctttggtggaaactgaacgtttaactatgggtcatcaactcatcatgcaacctgaactgcctatcatgaactgggtactttctgacccatctagccataaagtgggttgtgcacaccagcattccatcatcaaatagaattgatatatacatgatcgggctcgagaaggtcctgaaggcacaagtaagttacatcaggaagtgtctcaaatgcccatggtctccacctctgccaccctgccttttctccctcagcctgaactgagggcttcatgaggagttccctatgatcagttgacagaggaagagaagactagggcctggttcacagatggttctgcatgatatgcaggcaccatctgaaagtggacagctgcagcactacagcccctttctaggacatccctgaaggacagcagtgaagggatatcttcccagtgggcagaactttgagcagtgtacctggctgtgcactttacatggaaggataaatggccagatgtgtgattatatactgatacatgggctgtagcctagtcttcctgttttcttagccctcaccagaatcctgctgctccaaattcttccagcctctgcccattatgcagttgcaaagttgcttccacattttcaggtattcatgatcaccaccaccccactccttatatcaatttttttaattagtccattttctgttgcttataacagaatccctgaaactgagtaattattaaagaaaaggaatttatttcttacagttgtggacacccaggagctagctgcatctggagagggctttcttgctggtggggacttggaccagaatcccaacgtggcaaagggtattacatgtcaaaggggctaagctaatgtgcttgctcaggtctctcttcctcttcttctaaggccatccattcccctccaaagacaactcatttatccatgaggggattaattcattcataagggcagagcactcatgtgactcagtcatctcttgaaggccccacctctcaatactgttaagttttagcatgagttttggaggagacattcaaactatagcaatactaatattcttatcacatttcaataacccagtagagtttatgacacgtagtggctactagtgagtgaatgaaggaaaaaagaaagagggaggcagggaggaaagggaggagaagaaatctatattctaaatctacaaaatgtatgggatgctttgctaacaataaggtagtatacacaaaatggctcagtgtagccatcagcactcaactagtctgactgaaaccagaaatggattttagtgcctgcagaaaagaatagattaaatatctcacaggcaatctttactataaactgtttctctccatcagatagctgataaggattgagggtcagtaatttcatgttatagtcctgtatacctccacattcttgattcagtggcttgatgcaatagatatttacttctcattcacataaaaattgattcaggtgtaggggtagctctcctccatgtggtgatacaggaagcctctgaatcacctctgtatcgtggctctgttatatatgactacaaaaggcatccacatcaagtggcagagagtagagaaggcccatctacttcgtaattaccttggctcgaaaatgactcagattacatacactcaaattccattggtaaggggttccaccttgttgcaaggggcctgaaaattgcagtcctgggtaagacagcctcttcctggtaacatccttcctctaagaagcacaagcacagaaccctggaaggcagctacctttttccctcactattcttatatctggccaccaaatatctgtgcctacttttcccaaaaagagacagccctaagttctacccttcaagcatctacctcacagtctaggatctccaggtcatgaatagtttctccatcaggtctgtattagtttgttttcacgctgctgataaagacacaccagagactgggcaatttacaaaaaaaaaaaaaaaaaaaaaaacaaaaaaaaagaggtttgttggacttacagttccatgtggctggggaagcttcacaatcatggtggaaagtgaaagccatgtctcacattatggcagacaaggagagagtttgtgcaggggctctcatttttaaaacaatcagatctcctgaggctcattcactatcacaagaacagtgcaggaaagacccgaccccataattcaatcaccattcaccaggtttctcccatgatacatgggaattgtgggagttacatatcaagatgatatttgggtggggacacagccaaaccatatcagggtctaaatgagattcctcctcatattctgaccttcctataaaccacaacatgagtcatctatccctcaccgcatcccaaatacaaaacacataggtgttgtgtcaggagcagaataactgcaattttaaaactccctttcagagaagggaagaaaggaaaagaagcagtgatcaccatttcctaacaaagtgagatcctgccaggcaggcattgtaaatatccccacttgggagaagcccttggtccctttcctccatggccctgtctctacagcctcgacaggttttctttttcatcatcctctatggcctcatctgaagggagtgtcaggcagtgtgcccaccttggagctccatagctctcataacctacttctttatacaaatttggaagtccaagggttgctgtagcctcaaacagtgaaatacgttttttaaaaaaatcagtgctagtcttttgggtaaaatagttctctcaagtactcagacagtccctagtctttctttctcccataagttatacctaccagtgatcacatccaatgtaattccctagagtcctcaagtcttcttctttttctctgtcactctcgtgtgacaagcattattttctcacattgtccaggtgaagtcacaatacctcacctaactgaagggaccctgggaattgtagctcttggctgagctttccagtaacaatgctacaccatgtaaggaagtacaaatcttgggtgaatagttaaccattgtactatagctccctaagaatatttggaggaatatgggtattctatatgcatgtaatataaaatgctgctgctagctcttcttttaaatacagtggctctcagggccaagtgtggtggcttatgtgtgtaatctcagcactttgggaggccaagtcaggagtattacttaaggccaggagttttagaccagcctgggcaacacagcgagaccttgtttctacaaaatatatatatatatatatatatatatatatatatatatataaaataaattaataaataaatacagtggatctggatttaaatcccagcttctccgtttataacttctatgatctcaagcacttctctattccttctgaatgccacattttgttatctacaaaatattggtagctgtacttacttcacaggattgtttaattaaattacatatttatttaactgatcaatgatggttgagtaattcaaaaagaatatggacagttatcttgagaatagagcccatatctgtgttcagtttttgttataacccaaagataattaaacaaaacttagacatgctgatatttacatctctaagacatttcatacattataaactttgcattttgagcattttattttctttgctgcagaattagctggtttactgtgacatctgcttagcagattatgtatagtaccttttctatttctgccatttttatttttgcattttgggaaagtgataacgaccactccaatttagttggaagaaagccttctgattgcacagtgtttgatccaaatttgtgtagtggtaggacgtgcacttttgtagaattcagcactgaaggattatctactttacaagaatattgttttaattagtcgacaaatgaataaatgatttatgcaatgaagtatgggcaaactaattttctctgaagaattctccatagatatttatattgaacaaatatataaatactgatgcagttgcagacactgaaattagcattcagcgtgaaaattttttgaaatgagttccagctgtaaactgactaggagggaattcttctatttggataagatgtaagaccccttggcctaaatcggtggttctccagtattagcatgcatcagaatcacctagagggtttatttaaacagatgattgggcctcatcttcaaagtttcttcagaggtctagggcagggatgaaaaatttgcatttctaaacaatttccaagtgctgctgctgtacttgagaacacattctgagaaccacagcctaaagcagaagttgggagaactacattttgcataccctatctggcctaacatttgttgttgttgttgtttgtttgttattttgatttgttttctaagagatgggatttcactctttgcccaggctggaatgcagtggtacaatcacagctcactgcagcctcaaactccagggcacaagtaattcttcctctttagtctccaaagtagctgggaccacagacacataccactatagccagctaatttttctttttaattttttgtagtgatggggtcttgctatgttgctcaggctgttctcaaacttctggcctcaagacgtcctcccacctcagccttccaaagtgttgggattatagacatgagccaccatgcctggcctatttttatacataaagttttactgtaatacagccttccttatttatgcattatctatagcttctttcacactatgacagcaggaataaatagtcacaatggagagcatatggcctgcaaagtcaaaaatacttaatatctgttcctttacagaaaaagtttgctgatccctagataaagaatagggaggtgagtgtggaagaagacagcaagagtcctggccccctcccttctatctgagcctcacataaattcccttcaataccttgagttagatattagcaggagtttgccagcagcgtattcaattataaggacaaatcatttatatatgcctgtcattaaataataaaaattaaaggtaattgaattacccacttcagtacccagtttattctagatggacagaagacttatgtctaaaaagaatcacaaaatcagctttcttctcaaacttatggcttctagaaaagacatacaggttaactttcccttttgaggtgacaaagaagctccatcaatttgatgaattgttcactgcatgtccagttaattagacacactctgtcatctgcatccaaagcacagaaactgaaacaaagtgtctatggcatagaaccaaataatctgaatacaatcactacttaatgaggtcatcttcagtggagtggagtagtcagaatggacagatctgtatcaatccagtgacttcttggctttgatcactgtactgtgctttaccttaggggcactaattatccatccattgcatttctgagttttccaacagtgaaagttggagaatcagattctctttcataatgttgggtcagttgctgtcaccatttggaaaagatatttttaaaggatttgtataatgttggaatgatgccccatattttaaaagtgggtaaagaaaagtgagctagcatttgttaaatatccatacgtgtgccatgtattattgtaggcatttatgtttatcagctccaacacacacaatgcagcctcctaagattagtggtaagattattctattttatggagaggaaaactgagatgtagaaaactaaaagaactttctcgagttcatctcactattgagtgctagaaccaggattgactggttgtcagtcattgactggctgtctaaaaaccaaactgttggctactccattctgtccactgcagttccctcccctaaatttgctagatttgataactcaattcatccactatgcatcacttgctcaggatccactcattcccccagtgaactcttgtctgctctacagaaattgtccttgttccagaaccattgctccaaaactctccagtttctgatctgatcattaacaagccaaaggtttattccaaagctctagacaacagttagatgggtgtggatggtagttgaaaattttaaaaaatatacatttgcacagagtagtgtaactaaaaaccataggaagcaaacccagactcatgaactgaataatgccaaggctggcaaataattttcatctcttgagtgaactgtgatcacttgttagtagctgctgcaagcctgtgtgaggaagtattctgaagcaatgttctgcctaggaaagctatattctgttcttaggaaagaatgctgtaagcagtaaacaaaagaatcaacatgtacagcacgacttgccagatatggatctaaacactttattaagttggttaatcctgcaataatcctataagataggtacaaaggagagaaataaagcaccaaggttaaataatttacccacaccacacattcagtattattaagtggcagagctgagaagtgagctcaggaattctgctgcagttggtggagggtgtgagcagttctgccagagagcagtagggtgtgtgagagacatttgcatccctggggtcatctcctagtaaaaggacaaaatgaggaggagttctcagggcttcttaaactgttttgtgccttggagcccttaacagtgttataaggtccacagacaacttctgaggataatgtttttgaatgcataaagcaaaaatataaggcaactaataaaatcaattatattgaaatctgattttcaaaatatttttagatgtaaatttgtgagacagtaatatgcatacttctttattaatacagtaaataacaagatccatcagtgagtctaatagaaaccagagttttaaaataatgaagagcataaacaatgtttcaatgactctattaatacgacgactgtactgttaaataaaaatctttgtgatttctatttgtgacaaagtcacaggtactgctaattcaagggtagtttgttgcattctttcataattgaaggagatgcttaattgcagttaaaggttaatggaaggaaagaggtgatttttttttttttctatttaaggccacagaccctgtgggtctatccactgaaacttcaaagtacattgagtacttcaactgttaatgttgtaagaggaaaactggatatgaaaggcagtagaaagaaatttaataacttctctgtaattgtgtaacctgaataagtcagctaacgtctctgggttttcattttctcactgtaaaatgggactaaacctctcttattagactgatgtagagaagaaaaaacaataatctagttggaatgacattgtgggctataaaacactgtgttaattctaagagatcttaataactgttagagaagcagccacaagttagtatcagaatttgagctgcctgttactcaggtttcattagtgctgtttaaaaaaacacagcttcattggctgcctactgtgtgtccacactagatttatttccatgctaaggtacaaatacaaccttcaaggagattggagtctactgtgggaaaaacagatacatctccacaaaatagtgaagtacagtgaaagagaaatgcacggaaaagatgcagggaaggcttcctgcaggaggcggtgtaccaagccttgagggttgagtaggaattaggcaaagaaagaagtattgatgttacagctacggggaacagcatcatacagagcacagaagtaagatatgggctttgtatgcaggaaatgagactcatttcatcatttccaaaacatgaagtaccaaagacaaaaggggagaggtaagggcgagaacagagaaggtcctagctgctttgttagagaatgtaggcggtattttacagaggatgcgagaccctaatgtcttctaagtaggtgatttacatgatcaaacttatgttttagaaagaaattgcaaattggtgacctagaaaaatctaatttacatatgtgttggcccaatatattgaatttcttcttcctatatttaaaaataagaagactaccctctctccaaaaaaacacaaagatctaatatctctgagtccatattgcacatggcatctgagtaatgatgtcccatttggagcagacatgggctcttcaggtggctataatctccccacttcctgtttccttgccaatgctgagcccacatgagtgtggccatttatcatcaagcttaaagcacatttttcttatggtgaagatatatttctttgtattcatgtctacatgagtacagagtacttttggtaaaagtgggaaagtgaataaacaaaaggtctacatgcttcaagaaaaacggaaaagatatttccttccttactctagcctgctcttctcactcacaggacctgcctggagctggacattgtgtatgcagccccttttgccaggcacagcgcaggctgccagactcatggaaaatgggttttttgggacagaactggaggcaggtagaacagttagatgattgccatgatccacacaaggaatgataagagtgggagttaaaattgtagtcctgaggatggaaagaagggatgcagtcaaacaatccattggagacaatataaccatgggattcatgattcattagctttgaggataatagaggaaaagagtgatttgcctactttctagtttgtacttggaggctgtttatgattcattcaactaaaagactaggaaaggaaaggcagatttagggtgaggagaatggaatctgttgtgaacatgttgagctggagataaagttgggacatatatttagcaatgtttaacagaaaattggatttatgagcctgaagacaaagaggtctgagttacaagtttgaatttaactagtgagcctcagtctgttggtaagtgaagccatgaaagtgaattctatcactcaaggagagcctgaggctcaagaatggctcatgggcaggtgcccaggcaacagtgtattttaaggatcagatcccattaaaaggaccctccaaacaccactgcacaagagtgaaaagaatccagagatgaaggtgttatggagaccaaggaagtagatttttaagaagtattaaatgcaataaaatatgaagaaaagggggtcccaacattttggaaatttgaaatgtatagttgctcttagtgaatttcagtagagttataaggacaacacaagatcctaattacatataacacttactacatgactctagtaatgtagtcatgtctgtagtcatgtagcaagtgttatgtaattatgatctgatgttgtgcttatatctctactgcaactaaactccctttacattgtaactcatttgaaactacaatcttatgagattggcaccttggttatccccattttacaatgaggaaactgaacgaaaatgaagttacattactttcctgaagaaacacagcaaataagtgatggaattaaagtttcaaattcaggcagtttagctccagagtccaggctcttgacttcattactatgaaactatcttttcatattgcagtgagtaacaaatagggtagcccagtttatgcccgttgtcccaatatccaggctatgaagcagtcattttccagatttagataaaaaattacatctgaccacctcactcatgcaatataaggacaataggaaaataaatattgtaagcctagacagttctttttgccatagtgtctcataatttgtaagtcctcaataaacgtctgttaaatgaatgcatcagaaatattcattatgagagcagttgactgatatccagagggtaaagactagagcatattaataagactgaagggaggttgtcagtagaggaggaacttgaaggaatgcaagacaaagtaaacgactaatttagtgatgtttcaaaagagggagaaagagatggtgctgaagacagtcctgcatcacaaaggaaaaaaaggctattaggccttttccttgaagtcatatccccatatccctgtcatcttccccttccatctgtacattcaaaaatattctgagcacaaaagaggttgattttggggaaaaaaaagtataacagtgaaaacagaagtgggatttgtataggtataatgacatgagaagacactggacagaaagacaacaagaccaaactgacagatgagactctctccacatcatagggatcagagccatctgttaagaatgaaagagttgtgcgggctggaggggagaggtggtgatatgaaatgggtcattccaaaatgagacagggagttagctgatactaaaaggattaaaggtcagttctgatggcctaacttaagtgggagaccatacatttaatgtgacaagcaagttttgtgctgttctgcatggaggttttcctggacactgtgatgacaggatggaaccgtgaaggaatctggatggatttctgagggaggtgttcagatgatcacccaggatagaaggaaaggccaagagaggggaggatggctgggagaaaacaaaaggacccagggtctgaatgcttccatgatggtgaagagtaaggaaggaaagaaggagggcctgagaaggcctgaaggacatgcggttgtggtctaaaaggagaatttagttttaaggagccacattgctttcttatgcactgtacttttattagaacatgtcggctgggcgccgtggctcacatctgtaatccctgcactttgggaggccaaggtgggtggatcacctgaggtcaggagttcaagaccagcctgaccaacatggtgaaaccccgtctctactaaaaatacaacaattagctgggcgttgttgcaggaacctatggtcctagctactcgggaggctgagacaggagaatcgcgcaaacccaggaggaggaggttgcagtgagccgagatcacgccactacactccagcctaggcgacaaagcaaaactctctctcaaaaaaaaaaaaaaaaaaactagcaaacaaaaaacctggtaagaacatgtctactactatgcttactcagccatggaaaatgccctatattgtgtcaagcagccatgtgagtttgaattctataccaaaatgaacacttggaatcatgtgccccagtcaaagaggatgtctttgttttccatcagggaggcatccagggcatgtgtgaaattgattgtaaatcatttgtgttgttttctagatattgaacatgcccatttaacatatttaatgtgtttctgacatttacaaagtgtctggcaagctttgggcaatcattatttaaggcatttttactgaaagtacccctgagtagttcctaaacactgcattctttttcaatcgattctgaatatccctgaagagggaattgtaaatgttgaaaactgtagttgtcaatcatgggctcatctactcgcctctttgaatgataatataaattcatttgaaacactacagtgttgctagatacttggggcttttttccttgctgctatagaattgctttatttcagtaagattcaaaaaatgaattaatctccagagacataagcgcttactaacctcgagagtcacccgactccagatttttgaattctttttaagaatgatggggtttgagtaggtcagaggtagtgccccaaaccctctgtcttgacaagagagccattgcagactcctttcacccttgtttaatttgtgctggggactgacaggtcctatattaggatgtgaaaatgtctgcaatcagaaaatgcagcatgtttccaaaatgacaaaaatggtgcatgttgtaaatgcaattcttcttcaagtcacttttcattcctgttctgatcaaaatgcaagctgtaacactatcctcagcaagtctggaggcttctggatgccccaaatgaggaggatggcatatatatgggcttgaaccaccaggtgagaggaggtatgtagtggttttgtagatggaaaatgcaaatacaaatctctttgttcttaattatatttgatacattctctgcatagaatatcaattctatctaatgagaaaatgtacagctaggccatttggcaatgggcaacagattctgtgtaagcatctggcaaaggaataatttgacaaatagcaatatgccgaaattgtgttagataatttttgaggaactatttgtcagggtgaatgctcattttattcctgggatgttattcatcaacgccatgatttaaatgacaattagctacaaggtttacattgcagctgagcttttcatatttcccataatcctctgcatgcatattctttattgataaagatgcagtaacttctagggcctctcaccttgacactctgctggaaatctgaacttcactctcgggtgaatctgagtaaataaaggcttaaggagaagggctgaaatgagaaattaattctttgcacatcccgtggaagttgaagcaggttaacagatgttctgtaccaatggggcacctacagcaacttgtaaatttatagcactgactgcaattgtgttgttaaatgaagattctgcaacttcacaatgtgagaacctacagtagttgacacaggaattataaaagaatagtggcagcttttccaggctctccagcattatttctataagaaatacaggatcatcatatgtactaagtcccttaaatattcttccctgtctttgaattcttcttcctttcaccccatctattcatttgcttctactgaacttgattttactagcattttgagccccattgtccccaacctattccccagcctatcacatcccagctggccttgatgtccttccttcccactctcagattttagggtcagctatctgaaacagccttgtacaagaactgtgaatttggaagcccatatctatagttctccactgtatcctgtttgatatagcccagagctctggattaatagaggaatcccttacctctatgcctattcctgagcttctaagaagggttggaaatcttgagccatttggacactatgtaaggaccagttcttccatcctcatctgagctcttagtgacaagtttttgttactgttgttgctggtccataacagctactgtttcagatcttcctttccctccttgagcctccacacccacacttattcttctattcttcattacaagttgcataagaattaccaaaaatgttcacttaaaatgctatgtccctaaggccaacccccagctattctgattcagtaggctagggtggcatccaggaatctgcattttttatttgttttcatttttttaattgacaaataaatgtatacagttgactcctgatcaacacagggttaggagcaccaatcccctagacagtcaaaaatccatctataacttttgactcccccaaaacttaactactaatagcccactgttgactggaagcttcattgataacataaaacatcgataacatgtattttgcatattatatgtatattatacactgttttcttacaatcaagtaaactagagaaaagaaaatattattaaagtcataagaaagagaaaatacatttattattccttaagtggaaatggatcatcataaaattcttcattctcctcatcttcatattgactaggctgaggaggaggaggaagatgaaggcttggtcttgctgtctcaggggtagaaaaggcaaaggcagttggaggaggtggaatggggaggctggagaggcaggcatacttgatgtaactttacagaaatgcatcataacatttgtctgatgtttttgctttttcatttctctaaaaatgtttctatatagaaccaattctctacccaccatttgctttagttttggtacccacgttataaaagaagtcaaagcagtcttcaataattggaatgcttctgccagactgtccaaggtcaatttgttttctgacactgcttctccatcttcttcctcatcatcaggtttcgatgcattcatctccatcaatttgtcttctattcattcctctggtctggtgtgcattagctcttgagtttcttcaagatccgtatcctaaaacccttcatcccccaattttttttttgccatatacatgatcattttcaagattttcttgattggccctgtcatgaattctgtgaagtcatgtacaatatctggatacattatacattctccagcaggaatttattgttccaggattgatagctttcacagctttttctgtaacaccaatggcatcttcaatggtgtaatccttccagactttcactgtgttctctctcagggttctcctacatagcactgacaaactttttatagagtgtcacgcttaaggagccttttaaaggtccttatgactcccttatataaaggttgaattaaatacatggtgtttgggagcaagtagattacttgatgccttcagtgttgaactaataatggaattctgggtagccaggagcattgtccaatattagaagaactttaaaaggcaattatttactagcaaggtacttcctgacttcagggacaaagcatcaatggagccaattcagataaaaaggattcttgttgtgcaggccttcttgcacaacaaaaagcctggaaattggtatttatcttttcccttcaagactcaggggttagcaactttatatataagggcaatcttgataaaaacccaactgcatttgcgcaaaacaatacagttagcttcctggcttaaatcctggtgcttgcttctgttccttaccaataaatgtcctttgtggcattttttcccctggaataggacactttcatcttcatttaaaatctcttcaggcagatgctctttctcctcaaaaatttgtttaacagcatctgagaattggtctgcggcctcttggttagcagaagttgcttctcctgttatcttgacatattttaagccaaacctctttttaaaactattaaaccatcctttgctgccattaatttctccaggtttagatctttcaccttccttttgttttacgctgtcaggtaatgacttctgtttttctcaaatcacattggagtctatgggtatggctttcttatagcaatcttgcacccatataaaagcttcatttcaatatgatatgaaaaggtatcttgcaaaaaatgcaagcttttgcgcctgctggcatagttgcagctacagcttcccacttttcttttttctttttttacaatggtccttaagccggattcattttatcttgaaatgataggcaactgcagctgcagacctcaatcaagcaattcaactttttcttgtaatgtcatgaattttctctgtttcctaggaacacttcaaccatcactagtggcacctcgtatgggtcccatggtgttatccaaggtttatgatactgcgctaagcatgatgaaaaattcagaagaaccataagagatcactttttactgcagtatgcaatttactggagagatgtactgttcacttggagataattagagtcacatggcattttaagtaggtacttgtaacacttcaactcactgcaatagcaactgtagggggctacaaaattacatggtagtatactatgtgctacagttaattttatgcagttaggattaatagtgcatgtttatcttggtttatattctctcaactgtgaatggctccatgtatggcctgtaagtgtgtgtgtaaattttaacaaattttaactttttataatagatttatgcatatattatggttgtaaatgatcaaatagactactctctaaatatatgttatgcattcatgacataactttcttaacatttttgctatttctaggctacgtagttcatctgctagtttttcaaattgtcacatgtctaaaaaattgttttgaatacatttatttttaaaaacctacacaagtggacttgcactgttcaaattcatgttgctcaagggccaactgtatatcaactacaacatgttgttttgaaaaacataaacattgtgaatgtctaattgagctaatatatgcattacctcacatatttatcactctttgtggtgagaacacctaaaatttactctcttagcaattttcaaaaatataatacattgtcattaactataatcaacatgttatatgatagatctcttcaatttctaactgaaattttttatcctttgatcagcatcttcccagtcccctccttctccaagctcctggtaactaccattctactttctgcttctatgtgttcagcttttttagagtccgcatataaatgagatccaagatgttttaacaaacatcttgtgattctgatgacattgtcccatagaccatgatttgaaatactttgaaatagtttaccctatcactcatgggtaagctcatgggatgaacccattagacattttaatgatctggtgatatggtctggatttatggccccacccaaatctcatgttgaattatagcccccagtgctgaggagaggcttggtggggagtcactggatcatggaggtggattttccctttgctgttctcacgatggtaagagagttctcatgagatctggttgtttaaaagtatgtagcacctcccccttctctctatatttccccttctccagccatgtaggacatgcctgcttccactttaccttccaccatgattgaaagtttcctgaggcctccacagccatgcttcctgtacagtctgtggagctatacaccaattaaacctcattataaactacccagtctcaggtagttttattatatcatgcaagaactaactaacatatctggtcttattctactacaggagcattttatgaattagtacatggacatttgataagccagaattgcagcttgtttttcatgagaaccatatacctgttcattgttttataatttctaagagggctcaggaaagttaagcagtctgtccaaagtcatcaactcagaatccagtactaagacacaggaatctgattctaagtttattagtcatcccacttttcccaaagtggctttttagattctcaacaggaaataaataacatgttggcaactactgttatgacatttccagatgtcttatgtacaaacattccatatgaaggtcactttgaactgctggggaaacaatctttcatgcttggagtagagacatttttaaacagtgcttcccactttttttttttttaaactgtatcactacttccataagaaagggcaaacctgaatgtaaatccagttatacttagtaatatctggggcaggttccctgggaaacagactctaaaacagatttactttcgggaggtttattgagtaacgacttcaggatcaacatctgtgggagaggcagggcaaggaaacagcaatctacagaaaaaggagctgaattgtggtacagtcattgcaaagcattagccttgttctcacagcgagaattcttcagagtttttctcctttaggcaaagaagcagccattctatccccacatttgcccgtcattgagtgcagggtgctccctgggaggggggtaccattttgggcaaggaagtgctcatcagctgagggcaattcccattgcaggagctgagggaatgagtgtcttgtcctgagaggggagtggggaggatcaggtggcaccccacaacatccattacaagtaataatttccttaacctgtaggacaataagcaataacactattttttaaaatagtagacaggttttataacattaagagcacttgaagttattggaaaaattcttcccatactttgatcttgagttcagaagctatatcttagagagaaataaataaaaatttttaagtagtgactcattttaaagaaatgctatttttgttctgttttttaacgcactagaagaataagtaatgattcagactaaactgttcattttgtaaaatacaagttctgagaattgaataaatataactaaatcctaactgtgaggacaaaataaatgaaactaatactagttttatgggagctgaatgaaagtatttgcagttgatagaaagtattatctcatctttgaaacgaatgataaaatcaatacaaagagctcattgccaccttttccctaattccctatttacccatataagactttcactttaagatatcccagtcaaatactcatgaatatcatccccagtgaaagaaaagaaattgataaacaaaggtaaacttctcatgtgtaatcagagatacctgaagctctagaaactataataaagatgttgtgctttttacccttaaacttgggttgtgcttttaatatttgttcagattcacaaagtaattaacgaccctttacttaggtagatcatgagggaaacgtgttaaggccgtttattgaggcttgagagatggacaactgcatatcatctctgaaagaattactttatggttgttccttcaatctcccagtatggctaagaaatagcttttcttggtctcagaaggaaaggaaaaatgaggctttaaaaaaaaaatgccttctctcccaacagcaaaaatttagctgaaaattggctataggtggcattagtgaagttaaaaaagggatgggacaaaatatacccatcccttcaaatctcagaattccagatttggaaggaaactttagagcatcctgttccatcctagaccatctgataaatccaggtcctctcgtcttacctcatgaagatgtcaatacaaggatggcaggagattttgtttttttcttcagcatccactacctagggtctggttccttcagtataaaggatttttatttttttaatactgccactcaggtccaggggagagacagacttttagcataatatggtatagggtacatgctagcaggaacgtaactatcctaataaaatcaattgaactatatttttaagaattgaattcagaagtaagatctctatgagcacatcctcctcctcttctctgtgttatagattcagagcatctctcgctccttcctaagagtggaacccagagaaacagagagtgaatattcacctacatagttgccagagatgagaaaaggcagtacctggagtggctcgttaacacacaggttgcttcctgcctcccatcagcaaaggttctgattccatagacctgggctagggcccagtaatctgtatttcaaacaagttcccaggtgatgctgatgctgctagtctggggatcacacatagggaaccccattagactagaacttttccttcaaattttaaaaaatatatttaagaaaagaaatatatcttaaaatggaatcttcctccagaaacagctaaagaagatcagctcttagtgcccaagatagggcagataagagtccaaataacctggccatggccaggtgtggtggctcatgcctgtaatcccagcactttgggaggctgaggtgggtggatcccctgaggtcaggagtttgagaccagcttgaccaacatagttaaacctcgactctaatgaaaatacaaaaattagctgggcgttgtgatgcatgtttgtaatcccagctactcaggaggctgaggcatgaaaatcacttgaacccaggaaagataggttgcaaggagccaagattgcgccactgcactccagccttggtgatagagtgagactctgccaaaaaacaaacaaacaaacaaacaaacaaacaaacaaacctggccaggatatcctgaaggaacccaggccaatgaaagtgcatatatatatatatatatatgtatgtatgtatatatccatcccatctagagatttttagctagttggacctggctatgtgatccaattatttttcccctaccagcatccaatctgttctcagccgctctggctgttctcactgaatcttagtagaggtgacaaattgaagagggactgaagctttcaattagtataccacccttgccatatttctatgttcctttcataaggaaactctagtgttaggcagaacccaagcctaccacaacatatcaccatgatgtcagtaagaatgaaaccctgtctcagttatgttcatctgtcctcaagcagaagacagttgcctgtagtcccagttgtctttcctatagaaggcaattctggctgctctgtcctaggactcaggacaagaccatagacatgtccatctccactgattttctgatactccaccctgtgacttatgcccagttttctggtagcactttcggctgttaatatataatgggttaaatacctttggagaaaagaaacagtcactcctggagctgttgtctgggttgcaacaaagatgtttatttaggaaaagtggggggaaaatcaaactatgcaggaataatgcagttagtgattgtgaggcattgataaaaacagaatacattttcactgttaaaagttacactttggaaaactctggaaaattctcagtacaatggcagataaaaaagacaaaaagcttagaagatttttggctttttatttgtattttgctgtattttgagtattcctaaatatatatctacacttatatttttcaaaatatataattaaaaagaaataaaatttggcaaacataatagataactgatatggtttgcctgtgtccccacccaaatctcatcttgtagctcccataattcctacatggcgcgggatggacctggtgaggggtaatcgaatcatgggggcaagtcttccctgtgctgttctcatgatagtaagtctcatgagatctgatggtttcataaatgggagttcctctgcacatgccctcttgcctgccaccatgtaagacgtgaatttgctcctcactcacctttcaccatgatcatgaggcctcactagccatgtggaactgtgagtcaattaaacctctttcctttacaaattatgctgtattgactatgtctttattagcagtgtgagaaaagactaatatagtaactgattccagataaattctatagaaaataagatattctagttccttttcattactttatatctgattactactagttttgtcttaagtcatatcatcaggatagttccttgtcatagagtaaactgataattttaggcttacctaatatgctgttttatgttacgtggaattatctcctttgatagtaaccaggctttttccagatttaattatgacatatatcagagactccattgcctgacaagcaaaatgaaattccatggaatatacatattttagctgtcattggtaggaaaagcttcctttttgttgtgagtgtgatatgtttaccatttagtgaattccaaaattggaaagtagtaaggtaaacaaaacaactctcaaggcttgctattttcaatttaagtggcctctttaaaaatgtagattgggcaactcatataggcaaatgttgtcactctctacagggaccttgtgtgatccctagttcttagttatttggttgcttgtgattattataattttagctgaaagggcatcatagagttttctagcacatggatggtgggggcatagatttctatccaagttgacacattgatagagtcagccagtaaattaacagcagcagaacaccattaaattttaaacttaattgctgtctcctcttaatctctatggatataatcaatagatgtcagaaaaaagttaaagaagttatttagcgagcatctatttcctggagcatagtggaaaaaccactgtttcatttcagaactgatttaaacaacttgcaactaagatgctgtcacttataaggttttcatcaaaaagttttattttattcagttttttcattagcactttttttgacaagcatattggaattatcactgtgtaatcagtttgattttctctcaggatccgcccccacttatccttgccttttgtgttgtgtaacttctctactccatctttgttacttataaactccctttccatgtccacaatgaatcttgatccatgtcctgtgttccaaattttcatagaaaagaaaagctccatgtaaatagtgagcatgtccacatacccaaggagaagctttgctagttgatgttgggtgtcatgttgggtgaagtcaaaatcttatgacagttttttgttttttttataaatttggaaggaggatggtattccagttttattctccgtgttccatatctactgaattatggaccatagcatttacaggcaattacatagcctcctgaacagccatcttgagtaaaatggagactgtaataaaaaacaatttttaagtcagatttagacaaattcagtgagctacatggattaaaatctactcattaaatgaatggataactttttacattaatttcaaaataactgttttataggaccctttatagatttgaatcaacatactcttgatgaggtaggatgttatttcatttttatagacaaaggaacattgattttatgccattgtctttagccaagcagggaagaatacttccagcatagcccaactttctgttcatcagctgagcacctaccatgtaccagagactggtctatttgctggagctttgtagacaaagaaaacagacaaaaccctggctctcttttagcttgcagtctagtggggataggacagtgaatgaaaatgcaaaaagaatataaatgcattcctaagataatttcaaatagtgaaattacaatgaggaaaacaaaaccaggtagagagagagttggaatggagggagctcctttagattgaatggccagagaaggtctctcagagaagatacttggaatggacaaggaggatcccatctggtaaagttttgtggggagcgatgacagcaggttcagaatctccaaggtgaaaatgagtccataactcttggaaaaccatcagaagccccttctggttggagcagtgaaaggagacggtggcatgagatgtagaactgaggaaagccagggtcacatagtgcagggtcttgtagaggacagtcaaaactgtagatattttcatctaggcaatggcacatttttggtgggttttaagcaatggtagtgacattatatgatttgtttaaaaagtaatgtagccaatgcctgctgttggagaataaactgaaggtaggagggtggatgaaaggcagggtagtagtaagatatccttcctctctaccctttcattctgtagttccatatgtttagaataagcatgacactgcatgacttgctaagtgccaaaggagagaagaaatcagagatactttaactgctgaggcagatactgtttcccccttcttccttaatctacagaattctgattttatttgggcagcagcatacttagagaaggacagtccattctctagcctggaagatgagtcatgaagtcctaaaccgtacaaaataattccaatccccttcgctagtgattggcttaggcgtgggcatgtggctttattctagatactaaagaagaaatttctttgctgggtggatgggaggggagaggagcagagatcagtgataaagatcagtaaatgttattacctcttgataaaaatagagataacagagatcctctttcctctttgtgccttgaatactactgggaacaactagctttgcagcagataccttgtaaccatatagtgaccaaactcaacatgctaaagatcacagattagaaagacaggaagaatctgagtctgttgagcatcaaaactatataaccatctatgactagacagctgtaggtgtctaaagagtataagtcattattaatttggatgttccattacttgcagccaaatgcattctaattaatatatctgtgtgtaaatttgctaggtcctgtccagttcttcataattgaaaagtgaaagaagcaatgaaatccaaagtagctgtgagtgaaataacttagaaatttatttctgaagttaaagtctagatgcagatatttcagaactagaatagtgggtcttctatcttgctctcctgctggtgaaatctgttccaaagttaactcactggacaaggtggccacttcgtctctagccacaggtccatattctaaccatcaggaaagagaaaagacagagagggatatggcctctgaaggacaaccattctacttatatccatttgctcttagtcacatgaacattcctaactgaaaaatgttgtctgtttgctaggaaattatgtatacaacaaaaacttggggaataagttaccaaaagaagataatacactaggcaggggagtaaggggtgggataggggagggaattgcaggcagcctgtcttccacacacaactgtaacaaaagacgattggatatctgcctattgagaactgactgtattgtataattgttatggtagatgttatcatttgttgagtgtatcaggctttgtacttgaacttgttgctaaatattgcacttattcttctacttctgggcacatgataggcttatgaatttcctggcactcttgaggttgggctgggtatgagtagagttggcatacttcacttctcggtaaagcattatttattaatttgtgaccatacagagagtttctcctctgccacagtagctggcaatgttgcagatagtggctgatctgttgctctaatttccagagtatcaacaaaaatgaaatggagcagaactcccagctaatctacagtgggcatagaagtgagaaataaaactttgttttaagcctctgaggtcagaagattgtttattctgatggtgtgactcagcctgtcttgactgaaacaatacatgtattttctcttaaattatagcaatactaaaatgtaaatattgccatctccacttttcaagtgttcagagaaggttaacgacctgccaaagcccataccccttgaagtactcggtcctgtatgaacatcccttgaaacactgggtcccagcataaaatcttgagccctcccagttatccacactcccatcctaatgttgaactgcttatatcctgatgataaacactgttttcaagtcctctcggaccctaatagcccctgatttcaatatttttattttaacattagctcattgaccaaggggcagtcatactaagatcatggtttatcggaggaaccacccctgatatttcaacgtaggttcttttctattttccctaagtgtcggccggtctgagaaataaagggaaagagtacaaaaaatagaaattttaaagctgggtatcaggggagacatcgcatgtcggcaggttccgtgatgccccatgagcagtaaaaccagcaagtttttattagccaattttcaaaggggagggagtgtacgaataggaatgcattcttttcccagggctgttaattattaatattccttactggggaaagaattcagcgatatttctcttacccattttcggtaataagagaaatatggctctgtcctgcccggcccacaggcagctagacttttaaggttatctcccttgttccctgaaaatcgctgttatcctgtttttaaggtgcccagatttcatattgttcaaacacacatgctttacgaacaatttgtgcagttaatgcagtcaacacagggtcctgaggtgacatacatcctcagcttaagaagatgataggattaagagattaaagtaaagacaggcataggaaattataagagtattgattagggaagtgataaatgtccatgaaatcttcacagtttatgttcttctgtcatggcttcagcaggtccctccatttggggtccctgacttcccacaacaatggttacgggtagatgatgttaaagaagaaattattcaatgatgcttgtcaaaggtggtaaggaagattttattcaaggtgggccatgatgatagatgtgaagaccactgcaagggggtcttggactcgacttcaaatgtagcatgggaatttacagccaaggagcagtgtgaggtcagcagatagaaaattaccaagaggaaacatcaggggtaaggggagattctggctaaactggtttaacaggatttttcctgaaggcagaccaggttcctcagacataacctaggagatgctagaggatggggaacctggtttcaagggtgagcagatttcaagggcagggggttctggctaaactgatttagcaaattcttgctaaaacgggaaaatgcagagacaaacatggaaatccaaaagtcaggtccagttgaaaaaagagttcaggggagcctgagtagtttgatcaatgacagaatctttttcagtaaatgttccagaaactagataaagttgtgaacattatagtaaacatttaataggcagcctctgtcttttaaaagtaaaaataaccatgtactttactgtgatgtcaagatatgattatctagtccttaaattctcttaaattttcttccagggcacaaatcacatgcactttgacagggccctgatacatataaaaacaaaaacaaaacagaaaaccaagagatagtgataggttttgaactttttgactattttaaggatatgcatctaacaaatttaagcttctcatttcaaaatgaaagtaacacagtataattgtgttattcacaccataatattagaaggtaaaaaaaatgttaattgatggtacctagacttgagaggtggtgctctgaaaatggcatagaggttgaaatatgtatgaagaacatacttttctttcaatcctatgtgtgcctctgagagtatacaaaactttatttgacagtatcatcaaaagatgtcattgaagttctttgtatttgtgagacgtgaaccaaattactctcctggtccctcagtgacaggctttgcttcctgcatttactgttttccctagcagagcacccacactgctaggctgggccaagaaaagaagacagagatgaaacccaaatcggtcacactgaccacttgttaccccttcctgtcaagagtatagcccaagagggctctgaaatgattggacagaatgaagttttgagattatccatggatttcaattacagtatttgtgctctctgagacccccattactatcaatagttgagagttggaaatattgttgagatttttgagatttatgggattttttcactgggtagctacatccaacttgaagcccacattatcagcacttttctattatctgcaaatgtagtttctaagaaagacgtatgtttgctgtctgcatgactttagaaactgccaactcatcaaaagctacaccatttttagtaagacataaattccacgaggtgtcaaattatttcttgtcaaagtggttggttcattggaaagtccagaagaaaagaaagaaaaagaaatgagtaatacatctcaatggttcaaactgaagcacctttccaagcaattgttaggatcagtgctggcaaaggcttaagaggtcacagagaagaacacatttggagtatttttacggtttttaaaataccattaaaataatgaagattaatatttaaaacattttataaatataaatgtatataaaataaaaatatttaataaaatattaaaatactagtatactagtagtataggttattgaaagaagaaatttgacaaggagcactcaggagacatcattgctgtccagtgggaagtaggcatgtgaaaagtataattcatctcccatttgttgctcacttccaagactggctctcttattttctcttttgaaaagtcagagagggccgggcgcagtggctcacacctgtaattccagcactttgggaggccaaagcgggtggatcacgaagtcaggagatcgagaccatcctggctaacaaggtgaaaccccgtctctactaaaaatacaaaaattagctgggcgtggtggcgggtgcctgtagtcccagctactcaggaggctgaggcaggagaatggcgtgaacccgggaggtggagcttgcagtgagccgagatagcaccactgcactccagcctgggcaagagagtgagactctgtctcaaaaaagaaaaggaaaattcagagagagagattctttgagacattggaagctccactggcctactgggtcagaccactggctttgatgttagataacttgtattcaaattctgattctggtatgtattaattacacaaccttgtaccagtgatgggctgtctaagcttcagttttcttatctgcaaaatggagataacaacagaatctatagggacactgaaggattgaactttaaaagcacatctacagctccacttaagaacatgatggaagtaattgcttagtatcttgactgtggtggtgatacagtttggctgtgtccccatccaaatctcaccttgaattataatcatcctcatgtgtcaagggcaggccaggtgaagataattgaatcatggggacagtttctcctatactgttctcatggtagtgaataagtctcacaaaatatgatggtttcataaagggaagttttcctgcacaagctctcttgcctgctgccatgcaagacatgactttgattctcattcaccttctgccatgattgggaagcctccccagccatgtggaactgtgagtcaattaaacctcttttctttataaattacccagtcttagctatctctttattagcagcatgagaacagactaatacagtaaactggtactggtagagtggggtgctgctctaaagataccccaaaatgtggaagctaatttggaactgggtaacaggcagaggttggaacagtttagaggactcagaagaagacagaaaaatgtggggaaagtctggaacttcctagagacttgttgaatgtctttgcataaaatgctgatagtgatatggacattaaagttcaggagatgagaaaattgttgggaactggagcaaaggtggctcttgctatgttttagcaaagacactagtggcattttgcccctgccctagagatttgtggaactttgaacttgagggagttaatttagggcatctggcaaaagaaatttctaagcagcaatgcattcaagaggtgatttaggtgctgttaaaagcattctgttttaaaagggaaacagagcataaaagttcggaaaatttgcagcctgacgatgcaatagaaaagcccactttctgaggagaaattcaagatggctgtggaaatttgcataagtaacaaggagtcaaatgttaatcaccaagacaaaggggaaaatgtctccaggtcatgtctgagacccttggcagcccctaccaccacagacctggaagcctaggagggaaaaatgtttcctggcgtggatccagggttccccatctgtgtgccacctcaggacttggtgccctgcatccaagactctccagccatggctaaaaggggccaacgtacagctcaggccatggcttcagagggtgcaagtccaagccttggcagcttccatgtggtattgagtctgcaggtgcacagaagtcaagaattgagatttggggacctccacctagatttcagaggatgtatggaaatgtctgaatgtccaggcagaagtttgctgcaggggcagggccctcatggagaacctctgctagggcagtgcagaagggaagtgtgaggtacgagcccccacacagagtccccactggggtactgcctagtggggctgtgagaagagggcaaaccatccttcagaccccaaaatggtagatccactgatgacttgcaccatgcacctagaaaagccacagacactcaacatcagtctgtgaaagcatccaggagggagctgcaccctgaaaaaccagaggggtggagctgcccaaggccatgggaggccacttcttgtatcagcatgccctggatgtgagaacttggagtccgacgttcaagggcaagaagcatccagcatgagagaaaaatggaggccagaagacttagccagtccagtgtttctatgactctctgcctgcttttatcctagccatgctggctgctgattagatggtgcccacccaaattgagggtggatctgtgtctcccagttcactgacacaaatattaatctcctttggtgacaccctcacagacacaccaaggaacaatactttgcatccttcaatcctatcaagttgacattcaatattaaccatcacagtgtatgcaaagcactgagacttgggactgttaaggacaaaaactctggagcactatctgagtgtacccccattgtatctaggaagtaactaacttgcttttgattttacagcctcataggtggaagcgacttgcctactctcagatgagactttgcactgtgggcttttgagttaatgctgaaatgagctaagactttaggggattgttgagaagccatgattggttttgaaatgtgaggacatgagatttgggggggaccagtgacagaatgatatggtttgactgtgtccccacccaaatctaatcttgaattgtaataatccccacatgtcaagggtgggttcaagtatagataattgaatcatgggggtggttttccccatactgttctcatgatactaaataagtctcacaagatctgatggttttataaatgggagtttccccatacaaactctcttgcctgccaccatgtaagaagtcactttgctccccattagccttcagccatgattgtgaggcctccccagccatgtggaactgtgagtcaattaagcctctttcctttataaattacccagtcctgtgtatgtctttattaacagcataagaatggactaatacaggtggtatacacacaagccttctacatgtgacaaagttgtttagaactaaatacacacacacacacacacacacacacacacaaatacacataaaatgggggaaatttgaacaagataagtagattgtatcattatctatatatctatagatatatatctatatactggttgtgatattgtagtttagcaaaatgttatggaaagaaactggataaagggtatataggagttctttctattattttttacaattgcatgtaaatacataattatctcaattaaaaaataaaatgcctataaatcagttagctcaatgtgtggaatatcacatatgcctaataagtgatagcaactttttggagaagtgtctacttgtctaataagttactttgactaatgaagaataaggaatggcacatcattcaagctttaagcagaaatatagaaggcactctagatattttgattagctaaacatttaacacaggaatgacaggcttacatgactggcatgagggctaaggtgggaggagtgaggaaatttttaggagattacttttaagaaatctcgaagtaattgccaacaagttggagtcaatgatcccagctgctttcaagatcaaagtgattgattttcagaggaaaccacaaatggtgaggaaaagcactgcccattacctcagctacttaggaatcttcggtagctcagggaaactgttaacatgaaccagagaataatggcatgtatttcccttccaccttccaaacttcactcaggagcctctcactcactgtagctagggaatctatgaggaataggattctaggatatacagtggtaagcttcttcccattgacctagacgaaatgggaagggtatgatgattgattacagtgattattatgttgtgaattgatgacagacaatccacaacagatagaaaatgaagaatattttgccttgcctctagttgcataacttgctacatgggattcttgtcttaactttccagtctattttttttaagtttatagcgctcatcaccagacaccaaaaatctagtggtcttactagcaggtagcattatttccatcatgaaacttgctgccagagagcaacagccttgttgtttggtttgcatccttcccaaccagaattggtcaaaggtagaatgattacctgagataccaagcctcaggtctctgcagttgtctgccctcataggcccagtgcaggcaaataatgtcatgcaaaggaaatgtttttccaagtcttgatcacttggctttctagtgtgctttctgctcagaaaagactccagaaaggcctttcctatttaaggtagcatgctcactccccatctctagttattccattaactagctttgttgttgtatataatctccaagaggggtgtaacctttgctaacttgttctacactatatccccagggcctaatagtgcctgaaacatggaaagtgctagataaacatttgttgaatgaagaaagttttcaaggagataaaggtcaacatgagcaaagtgaattagctcagaatctagtattaagtgtgtatctgcaagaaaatgtatcacccccccccccaagtaaataaaaagccaagctatcctacttcttgactacagtttaactatcaaataatttcctagacactttacagaactgttgtctaacatcataatactagtatgttattattggtcccatatacagacaatgaaacaaaaattgagtaaatcaaagttactaagattactcaggatataagtctgtatgtttccagagcctttattttcaccactataccaggcttcttcatttctctaaaggggctagaaacaggggttgaaataggaatgaaacacttgtccattcatccattcgagaatctgaagctttgcctggaggccgatttccacacctgtgccccattactaagagctatggtgagttggctctaccatccatagaagcaagccagagctattcagctgtcagaacttgattcaaaagctttggaagttgtctggtagaatctagcagagtcaaactcactaaggtatgaactcaatgtgcagacttggtctctagtaacctgaaatagttcaatgcagtggttgtcaaaagaaccaagtttacgtgagagtatagcaggtgctgcatcttggttttataaatcgttgtaaattatctctctaactatattcccagccatttctattacttctcatggaaagcaaattcaaacaggcgtcatacctgaaaaggcatataagaaattaagacaaagtgagccacacaaatcatcactaatatatggtttctagtacaggaggaaatatagcacaagagagaagcaatgaaaatgacaaagataactttgactaccaggacaaagttcttgtttatcacattagagtggctttgtttttttcagagtggttgtgtttttcctattttatattacaaaagtggagagttcctcacagctgagatgagatgtgctgaactgattagctaagatcgtacttctttatcaaagaagctctggttctttgagttcaccattgatgataaaactgaaaatctctcttgctcagggtcagatgtgaaacgattcctggtcccaatctccagagtcactctttaaatgctggcttctatttttttttaatctcttttttaaattattattattatactttaagctttagggtacatgtgcacaatgtgcaggtttgttacatatgtatacatgtgtcatgttggtgtgctgcacctattaactcatcatttagcattaggtatatctcctaatgctatccctcccccatccccccaccccacaacagtcccctgtgtgtgatgttccccttcctgtctccatgtgttctcactgttcaattcccacctatgagtgagaacatgtcgtgtttggttttttgtccttgtgatggtttactgagaatgatggtttccagcttcatctgtgtccctacaaaggacatgagctcatcattttttatggctgcgtagtattccatggtgtatatgtgccacattttcttaatccagtctatcattgttggacatttgggttggttccaagtctttgctattgtgaatagtgccacagtaaatatacgtgtgcatgtgtctttatagcagcatgatttataatcctttgggtatatacccagtaatgggatggctgggtcaaatggtatttctagttctagatccctgaggaatcgccacactggcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttaatttgcttttctctgatggccagtgatgaggagcattttttcatgtgttttttggctgcataaatgtcttcttttgagaagtgtctgttcatgtccttcgcccactttttgatgggattgtttgtttttttcttgtaaatttgtttgagttcattgtagattctggatattagccctttgtcagttgagtagattgcaaaaatttcaggacatagacatgggcaaggacttcatgtctaaaacaccgaaagcaatggcaacaaaagccaaaactgacaaataggatctaattaaactaaagagcttctgcacagcaaaagaaactaccatcagagtgtacaggcaacctacagaatgggagaaaatttttgctggcttctaattttaaaggtcctgaccttaagctgttaagtttgagatagccacagtcttcagaaacctgcagccattcaacacagtgagaaaagtgctcgggacctgtcctgtttagtacaaaggttatgaaagggaagcatggaactcaactagtctttaaaaatgcagagatgacattggggattttgaggtgttttacaaacgtgtgaagaattccagtttaaccacctgaaattttacatctatttttacatatctggaagtgtagagtaataatgaatgaatagtttcacatgattaaagaagcctaataattgtcatttttcaagttgacttaaggtggcttcatagatatctatttcttattcaataattgtggctaaaagatatgctgtgacctggggccacacctaaattaaccctgaggattattttctaatacccatccttttacattcataggatttgttaccaggatccaagattatttttaaaggatatatagaacccatttgtaaccagaaaatttttataccaatattagttataactattagtgttttataccaatattatagttattagtaataggatgaaatgagtatgttctatcataatggttaatttttattattttgatcaatgtataacataaatattaaaaggctgctggaatttacacaaggtaaatacacccatgtatccagcactcagatgaagaaacagaacatgatcaacatctcagagacccccatgtgtctcctttcaactgcttcattcccccaaggatatctatcctgacttcaactgctgcattcccccaagggtatctatcctgacttctaacaccatatattagttttgattctttttgaactataaattatacaacacaattatatgttttatatatatagtatatactcttttatatattttaacataatttgtttatgagattcatccatattgttgcatataatagttatttcttttccttctcattactatatagaattccacagaatgagtgtatattttaaaaatttactctacttttgatgggcattcaagtagattccagcttgggactattataaatagtgcttttaaaaaaaaattcttttttgagatggagttttgcttttgtcgcccaggctggagtgcagtggtgcaatctcagctaactgcaacctccacctcccaggtttaagtgattctcttgcctcagcctcccaagtagcggggattataggcatgtgccaacatgcttggctaatttttttttttgtatttgtagtagagatggggtttcactatgttggtcaggctggtctcaacctcctgtcctcaagtcatctgcccaccttagcctcccaaagtgctgggattacaggcgtaaacagtgttcttatagacattctttatgtatcttttggcaaacatatataaatatttctgttggatataagcctaacagtggaatttctgaaaatatatatttttcagctttagaagatatagctagttttccaaagaggttctaccaatacttggtattatcaagtttaggctttgaaaaatacatattattggatatagagaggtaactcattgtcattttaacttgagttttagaatttgagtttagaatgagaggcatggatcatcagtaacacagaaatagttccactaatggcttggaaatcattcccctattcatgagagatttggagcctgtgctttgtccagcagaaaaggggaaagtgttttaaatcatggggtgaaatttagagcaaaaaggactatcagagatcaagactgaagttggtccttggaggtatgggcagacgtattccttgtgattcctgaattctcataggtaacagcagcagcatttactgtctcattaggtattcccaattttgccactctctttgtttaacaaattggaacacagtatggcaagttgacagagttgagaagaattctcagtgatgtgctcaaggcacctgtgcatatttatgtggtctgctcatggtcctcagcaagaaagtcaacaggccctttctaaatgagagatctggaagactttcagcaatctgtttgagataaaacatctaacagcatctatgacataaagtggaaataagaagaaaaaaaacaagtaaaaattactttcagtaaggcttagagtctgcaaaatatgggatcatgtctcaatgaatatttattcaccttccataagaagctaaaagttgaaatagtgactcttcccttacatgctggaatcatttctgtgccatcgtagtttattagctataaaatatgaataatcagtttttgtagattgagcctatcaattctaagacattattgcaagtggtcctcaacttctgttccactttgaaacaactagcaatttataaaatttaacataagaacaacctgaactataacatgtgagtgtacaagaaatcaaaaaatgttatttaaatgaataaatgattatttgaaaaaggtatgtgttgtatatggaaatacccaattctatatttctatattattaaagactccaaaaattaaatcaattttatgaaatattgaaatatcttttagaagtcacatatacatttttatgtcgtatatgtgtgtatatatatatatatacataaaaatatatatctgtaggccaggcgcagtggctcatgcctgtaatcagcactttaggaggccgaggcaagtggatcacgaggtcaagagatcgagaccatcctggccaacatagtgaaaccccatctctactaaaaatacaaaaattaactgggcatggtgacgcgcgcctgtagtcccagccacttaggaggctgagacaggagaatcgcttgaacccaggaggtggaggttgcagtgagccgagattgtgccactgcactccagcctggtgacaaagtgagactccatctcaaaaaaaaaaaaatatatatatatatatatatatgtctgtaccctataaactgtagctccatacacacatatacactaatatattgtctgtacatatatgtgaatacacatatttccactctgtataaataacagctttagacattgtttacatcttgctttttctcacttcttagatcttacagctctttcaatgtcctaaatgcaagacttccagagatcaatgtcagcatgtctctcttattttatgaaatggctacatgagtttacattataggcatctaccatgattcagttgaacagtctcttcctgatggacattttgttattttcttcctattaaagcaatgctgggataaacacaatacttgatatatttatataacatgagactatatttgtaggagagattctggaaaatgtacatgctcaatcagaagggctatgtgaattctgaaggtatttccaacatttttcacactcttttctctgcaggaggctgtgataccagcttcattcaaatcatagggactaagaagaggggaggcataattaaatcagtacaaggagtaatggatggttcataggccagaaaaataaacatatatacatacatgcacacatacacattcatactcatacacacgcatacacacacacacacacaaacacacacatcaccacattagggagaagccctcattttcagctgtgacattagctaacatggtttgagacaagtctttcacttctctaagattggattctctcatttgcataatgaaatacgtggcctaaagcattggctctcaaagtgtggttccatgcaaataacatcagtaagatgtggaaactttttagaaatataaattcttggggttggctgggcgcagtggctcacacctgtaatcctagcactttgggaggccagggcaggtggatcacaaggtcaggaaatcgagaccatcctggctaacacagtgaaaccccatctctactaaaaatacaaaaaaaaaaaaaaaaattagccaggcatgttggcactcacctgtaatcccagctacttgggaggctgaggcaggagaatcgcttgaacctgggaggcggaggttgcagtgaggcaagatcgtgccattgcactccagcctgggtgacagagcgagacttggtctcaaaaaacataaaaaaaagaaaaagaaatgtaaattcttaggatctactcaggaccaactgagtcagaaagtcgtgagtgcagtacggtaatctctgttataacagtgtcttctaggtcattctgaagcatattaagactagagaaccactgaactaaatgatctgtaatatcccttctagtattttatgaacctgtcaaatcctcagaaccctaggtgtctgtttccttctttttagattataaactctttgagagcaaagagtaggccagaaatccagttgtcagtagctattgtttcatacagcaaataatgaaagcgtaagtactataggaatccctgtaagtttggtcactttataaactgatatggtttggctgtgtccccacccaagtctcatcttgaattgtagctcccataattcccatatgttgtgggagggacccagtgagagataattgaattataggggcagtttccctcatactgttctcgtggtagtgaataagtctaaggagataggatggttttataaggggcaacccgttttgcttggttctctcgttctctcttccctgccgtcatgtaagatgtgacttgctcctccttgccttccaccatgattgtgaggccttcccagccatgtggaactgtgaatccattaaacctcttttctttataaattactcagactcaggtatgtctttatcagcagtgtgaaaacaaactaatacaaagactaccatgtttttgaacatacattgttgactttcaatatctcttttactgctggatttgagacttgattctgtgacaacaaagccatgagctctttattcaactcttgactgttatctgacttctgatgttatctggcaccaccagggagatcatctgagaccttactatgacaatggattgggggtctataaacagtgagtgttttaatctattaagtgtctgaagagtattaccacaaacaagtggtgtcttgctcaaactgctaaaactaatacagaccttcattctcagagtcactcatcttgggatctaaaagagtgttagaagaattggatgacgttatatacctcttttggctttcatgacaacacaccctttagaggcagagtttcattccgagctaaattctaccctaactcactacttctccttgaacagcttgcttaacattactgaaactctttctttatctctaaaattagactattaccttacctccaggggtattgagagactctaatttgttaatttatataaagcagattacacaattcctagcacataggcatatatcaatatgtcgtagcttttttaattggtctaagtttttgatcaataatttagagatttgtctctaaatcactgattcagagagagcatttcttaatacgaattccttcattattttcctactaccatggcccagcatctttgactcattcttcttcatttcacactgaaacacagtaatggtcttctagttgcaatcttctcaaattcaccctactagagtaattctcccaagacacaacttttacacagaatctgttactcaagaaaagagatccaaaagacagcatactttcttttttttgttttgttttctgagacggagtctcgctctgtcgcccaggctggagtgcagtggcgcgatcttgactcactgcaagctctgcctcccgggttcatgccagtgtcctgcctcagcctcctgagtagctgggactacaggcacctgccaccatgcctggctaattttttgtatttttaatagagacggggtttaaccgttttagccaggatggtttcgatctgacctcgtgatccgcccgcctcggcctcccaaagtgctgggattgcaggtgtgaaattcttaaacatttattctgcatttactgggctcctcctgtatatcaggcactgtatttggatattgtagacaccaagaagaaaagaagctggaagcctctgcaaaagagaagcaagttaaccaatgattaccacatggggttggcagtgctgacacagaggaaagaccagggagatgagaatgggtatagaaatcacctagaaaagtaacagagttgtcagtgaaaacttgcaaaaggggataacatttcccctaggtcttaaaagatgaggtagcaggtatccatgagttttgccacacagctttcatttcctacttctcctggtttaaaagtcctgattttcctcaagaagattaattcctctactctcttccttttggtagaactgtctatggacttcacccagcaggctgacattaacatagttctgagccaatttaaacaacacattcttgtagccagggtgatggattcaggcctttcggagctcctggaagccttattgccaccataagtagaaaatctgcctgagatttgagctaacattaggggaagaacagagcaatggagagaaagaaactagattctgttgacatagttgaagcctctggtcctggaagtgcctaaagttagtcctgtccctggactgtttaattcgtggagccactaaattcaacttctttcttaagccagttggggtcagttctgttgtttcttgcaatcaacataggtctttgccagacatagggaagacagatattcccaactaaggaatcagcaaataaaaaggcatgcccttgaaataaaaaggtgcatccaggcctcagcaagtagtctagctcagctatgccacagaatgggagtaaggaagtaacccagcacacactggagacagagaaggcccaactcataaggatcttgcataactttaaaaaatagatatacatgtcaggggtcaataaacattttctgtaaagaacagacatttctggctttgttgaccaagtatggtctctttcaaagctattcaactgtactctcgtagcagggaattaatcatagacaatatgtacccggatctatataatgcttcatggattataaaacccatttacatctttttcattaatccattcagcaaatatttactgaacactctttatgtgctcagttgtagcctctgattaagaagttatatttagcttacccactaccctgctttagagggattttttgtcccagttgtcatgggcagaatgggagaagaagacaaaatacaaatgagcagcaagataatttcagagaatgctagttgcaataaagaagggtagacagggagatgtggttggaagagtcaggggtttattttacctagggtggtttgaaaaatacctccctgaaacagattctgtggggctgatataggtaaacttgtgggagagaagccttcagagcagagggaacagcaagagctaagactttaagaggataatgcctttcacatgtttaaaaaacaggcaaagggccagtgtcactggagcccgaagtttatagaaggaaacaataggaggttgaggccaagtcacttatagctctttagactgaggtatgaagcttgattttatgccttgggaagccacggaaggattttaagctagggagaaacacaatctgatacgtacattttacaataacactgtccaatgacaatacaatgtgaatcacacatgtgactctacattttctagtagccacattcaaaagtaaaaagacacaagtaaacttaattttcatactgctttactccaaatgcatccaaattattgtcatttcaacatgtaatcaatataaaaattattaacgagttattttacattctttcttctttgtactaaatcttaaaattcagtgtatattttagacttatagcgtatctcatttggaaccagccacctttccagggctcagaaggcactctgcctagtggttaccatgttgaacagcatagttttagaaagatcactgtgactactgagtagggaatggaatatctagagcaagagtggaagcaagggaaacagttattggctattgcagcggtctaggtgaaaggggatgagccagggtaagagtagcagagaggaattaatttgggatgtgtcagggaggtaagatgcaatgcattggattggtgggtgaggtgaaaaaaggaatagaagctgatttctggaggttggcatgagcaactaggttgttggttctattttctgaatgatcaaagcctaggagagaaagaagctgggcagaagcagaatgaggagtttgggtttagatatatcaagttcaagatgcctattaagcaaccaggaaggcagttaaatggagtgattctgtcccaaggatccatcattaatcctagaggcagaagtagtttctcatatttcaaaatctttgaaaaagcaagttttaatcttcatacacttggcccacattctccccttctacttactcctctccctttttctaaagagattgatttcactttccatgagatgctacagtattttcagtttaaatagaaactttaaataaattggatttaaaatcttctcagggaaaagggaaacaatttgtttgctggggtttaatttcaaggcaagagtcataatcaaggctattttaacccatcctttgattaccttcatggcaacacatgctcttgcaaagataggaagattattagaattttaaggaggtggatgtggctgtatctacacacaaagtagcaatgaaaaggttcatgggttgcagtctccagcctctggggcctctaatccacccagaacaaataactgtcttttctcttaacaattgccgcagctacaggctacaaaatctctcttggtggtcaactgcactaccttatcacacacaagggtaaatgttgtcaacctgccagctggctttgccagatgtctaactgattccagccatttgttttcaaaacaacccacttgtttgtgctaagttgctctaccccaacccacactacatgtgttaacagtggcctaaataaatctgtgtttttgttgtactttgccactggcttacttagagaatcaggaaaagtccatcattttttgcctctactgacaaagtcagaatttagatgagtgtacctgatgaaatttttctgagccactccttatgcaatattgaaacccaagtttactcaccgtatttaccagaaagcatctaaggtatttcaattcctctatttcctttgacactccaataaatgtaagcaaattgtagttactataaaagtccttgcatatacctggtaaagaattctatattcagtcaattaaattcaaatgcccagttatttataccaatagatgattcagaccctctcactggctacttgcctgatggtagttcaccactgatttgcaccttgaactataatttctaggaaattttaaatactaaaatgtacattttgctatagtaaaaagccagtaagcatttaagaggaaagtttgggatcattgactatctctccagtcactgcttttaaacatttaatctgtaattcactgaaggtcagtaaaatggagaactttccttcactgataattttatttttttaaaatgtgttctcactatcacctaggctggagtgcagtggtgtgatcatggctcactgcagcttcgacctcctgggctcaagcagctcctgagtgagtagcctccattcctggctaaatttttatttttattttattttattttattttattttgttttattttattttattttattttattttattttattttattttggtagagatagggtctcaataagttgcccaggctgatctcaaacttctgggctcaagccatcctcagcctcccaaagtgctgagattacagatgtgggccaccagcccgataaattcttattaaacagatttcagcagcctgaacaactagttactaaattaaaaaaaagccatatacaggattgtttttgctttgcttgcttatctggccactccctgtggtctgaaacatgaccatgttcacaaattcaggccgtctacctggaccttggtcgttcccatttgcagcacctgatctgtaccatgcctccaacatgagaaaagcttagactttgaacacaaacagaaatgggttcaaatctcagccttaccagttgctagcactgtgatttgtggaacgctctttgatctaagactgtttcctcatatataaaatgaagatgataactcatctttctaacagggtagttgaaagagataatgcattgtactcaccaatacaagacatatagcaaagcatttcgtaatgacgacctctgggtctgcgaaaagaacccttgtttgatggtgtcaatgcagcattatttatcattaaaaaggtaagcattcagttaattacctggatgtcttgatatctgggcacatacacaactgagctacccacttctcattcaatatcttagcattttgtcctaatcagtgttttctacatttcgggggcagtttggtatcaccctatgtgttattggtatgctcatttttaaaacaatttaaaaccatttaaaatgtgagtttattgtgatgtttcattgccagtaagttttgacaacaaaataaagataaaatgaaatcaaataccagaaataacagtaattttatcctttgagatccgatgaatccaagccagatcattcttaaacttatgaaaagatgggaaatgttatgatggtccagagagcgtttgaaacatcagaatttaattgcaaataagagagaatgtcaattgtctagaaatgtgacttaatccaaaatattataatgtcagggaagctttgtggaaacttgatagtacttgatagcaaaattcggatggttctaattacagtcagaaaccagcatcatcttttttataacacactgtaaatttcttttattatttaaaagctctagatttgacaaaagaaaagaatagccaagttcatcatttcttaatttttcacagcaagttaattatgttttatgattcataagtcatcgcatatttgtaaagatggaagtgtgtgtttatttctacaaatgttaaaatttctatgactgttggccaggcgtggtagcttacacctgtaatcctagcactttgggaggccgaggcgggcggatcacaaggtcaggagatcgagaccatcctggctaacacggtgaaaccctgtctctactaaaaatacagaaaaaaaaattagctgggcgtggtggcaggtgcctgtagtcctagctactcgggagggtgaggcaggagaacggtgtgaacctgggaggtggagcttgcagtgagccgagatcgcgccactgcactccagcctgggggacagagcgaaactctgtctcaaaaaaaaaaaaaaaaaattctgtgagtggtgagtgttaaactgttctctgtaccaaaagaaaaaaaaaaaaggtgaagtgataaattacacattcatcatattgaaacatttagagtgttgtagatgtttttgcttgttctttttattggcatgtattggagggttttacagaaagaagccgctacgtgatctggcatctacaggttgcagtaagtagcacaaatttcttctttacagatgcccccacatagcaataagcatagtgtcagtagagacagataaaaccatatttcagcacctactagtatgcgtatgtattagccagggttctctagaaggacagaactaataggatagatgtatacgtaaaggggagtttattaaggagtattgactcacacaatcacaaggtgatgtcccacaataggccgtctgcaagctgaggaacaaggaagccagtcagagtcccaaagctgaagaacttggagtccgatgttcaagggcaggaagcatgcagcatgggagaaagacgtaggccagaaaattaggccagtctaatattttcacgttcttctgtctgcttttattctagccacgctggcagctgattagatggtgcccactcagattgagggtgggtctaccttcagtccactgactcaaatgttaatcttcttttgcaacatcctcaggggaacaatactttgcatccttcaatacaatcaagttgacacgcaatattaaccatcacagtgtacaaaaagcactgagacttgggactcttaaggaccaaaactctggagtcctatttgggttcaagtccaggatctgcttttgatcttgagaaaattcctcaaattccctaggcttcaatttttccatctgcataatggcaataagatacctgcaccacagggttttgtaaatattaaatgagatgataaatagaagattattagtgtacagcctgcaatatgatgagtgctcaatatatggcattgttgtctcatttttattagtagtggaattaaagctgttggtgttgattgattgtgttattttgggaaagctgtttaatttttctgtgcctcattttcctcatctctaaaatggaatcacctcatagggttattatgaggattaagtgaacatgtggctctgttataactggcaccaccaacagaaccgacatttattatgcacttacagatctgacaggctctgagctaagtgctttattttcagaatctcatttaatcctgacaactttcatattattatcctcatttggaacataagaaaactgagactaagaaaaattgagctaatgtcacaagtcacatagctagtaaggcagaagagttgcagtttttaactcatgcatatccaactcaaaggctttgcttttcatcattttgtcataataccaggatttgcagactcagattgctttgcacctaggaaggtaaatgtaatgaataaaaatgggaactatagcaacttaggagaagcgtgcctcatgcaaaaggagtagcgaatacctatcatcaccatgaaggaatgaggagccaatgctaccaattctatggtctaccaagaaaagtctgaaagccatattttgatatgaaattttttcattattaaatgtttaaagctaatttaatttaatttttaagcactgtgatgaccaaataaaatatatctgtaggccaaactctatttgcaagttgattttcaatgttcactctgtattgttctctagaaaagcatttcccatactgtggtccgtagacccccggtgtttttctatgactcatttagggtcgtgttcaaaattattttcagaaaataataaaacattcttctttttcactgtgttgacatttgcattaatgctacaaaagcgatgataagtagtactgctgtttccttagcacaaaatcaaggcagtggcaccaaaatatactagtagccattgttttatttgctgccatatgcacatggtaaaataaaagaatggccattttcttaaaaatgttattaagaaaccagtgaaaagttattaattttatttaatctaaactcttgagcacatgtaatatttcatgtgacaaaatggcaagtacatatattgtgattgtgaatcaaatggccagctggatgagccatcttttttacttaaatgaaaaattgacaaactatggttattcagacttggtattttgcaacccttttgtgaaacaaaacaaaataaaaagtgagactatcacttccaaggaaaataaccaatagcatttgttgccaatgatagagctcaagctttcaagtgaaaaattcaaattttgggaaattttagcttgacagatttccaatacttatggacttttctgatgttattggtaatgatatttaaaaaccactacttttattagacagtgaaatatttcaacatttcaaaagtctgcttaattcagtgaaccaatattttccagtgaatagttcatcatattacaaaatcttgcatggatataagaccactcacaggagaagacagaccagtggattttcaggtagccattgataaggtttcagagaaatattgcaactaaattttaagaaactactatattttgagcttttaatacgaaagaaaaatatccatgattatcttaaaagactgttataatcctataatattatcatatcatataacatttccccattttccagctgcatatctatgtaagggcaaattttctttatatgcttcaagcaagacaacatatcataaaagtttggatacagaagaacagagtgaaactaaaactttcttctattaagctagacatttaagagatttaaaaatcataaaataagccactcttcttgctaattttttttgttttggaaaatatagttatttttgtttaaaatatgccatttacattaacatgtgaggtttattgttaaataaattttaaaatatttttaatttttcacttttaatttctaatgcagtaaatatcaacagatatcaatagatgaacaaagttatttagaatcctctacaattttttcttttttttcttttttttttgtgggggggacagggtcttactctgtcaacccaggctggagtgcagtaatgcaattacagatcactacagccggacctcccaggctcaagcaatcctcccacctcaaccccccgagttgctggaactatgggtgtacactgccacacccagctaagttttgtactttttatagagatgggattttatcctcttgcccaggctggtcttaaactcccaggctcaagcgatcctcctgcctcggccttctaaagtgctaggattacaggcatgacccactgcagctggcctcctccacaatttttaagagtagaaagggatccagccatcccattactgggtatatacccaaaggattataaaacatgctgctgtaaagacacatgcacacgtatgtttattgcagcactattcacaatagcaaagacttggaaccaacccaaatgtccaacaatgatagactggattaagaaaagatggcacatatacaccatggaatactatgtagccataaaaaatgatgagttcatgtcctttgtagggacatggatgaaattggaaatcatcattctcagtaaactatcgccaagaacaaaaaaccaaacaccgcatattctcactcataggtgggaattgaacaatgagaacacatggacacaggaaggggaacatcacactctggggactgttgtggggtggggggaggggggagggatagcattgggagatatacctaatgttaaatcacaagttaatgggtgcagcacaccaacatggcacatgtatacatatgtaactaacctgcacattgtgcacatgtaccctaaaacttaaagtataataaataaataaattttaaaaaagagtggaaagggatcctgaaaccaaattgtctgataaccactactctggaatagtgctacccaacgtcatgtttatggatgggcactgtcagcacaacatgggaaatagttaaaaatataatttctcagcccctactctagacctaccaaatcagaatctctgcctgtatgtcccagaaatctgcatcttaacaagacttccagataattctgaagcccaccaaagacagaggagctctgttctacatcaaactgtatcgatgacctacctcaatagtaaaaaacatttaagaatatgccctcgatttatgtgtacttatttccttagtctacgtacaagcagttctgtacttacatattatgatcagtacataaaaaattaaaacatgcaccaaaaaaatagaaattagcggatatttgctgttgtgtacaatgcacctctatatggagactggtccttgtgggtccctggttataattgcattgctccataaaaggattaaaaacgctgtagaaactccctttcccactgtgattaagtcttgataaattaagcagaattgccttcttatggacccattctatttcaaccagtggttgtttttttgtttttttttgcatcaagtactttccaaaatactcagtggaggcttcggtatcactgagactttcttttataaaagttaaggcagcaaagcctagggaaatccgacttcagagagaatttctgagggagctgcttctctgatattctccattccctcatttctccctgaattcatctgatctctccatgagtgaaagaagaaaccaatgaatgaatcagaaaggagtgcttgcccaacttctctgttgttttattgtagtctttgattcatgactttatggatgagtttttaatgctgaagtttcaagataagtatctctggagtttgatagtttgcttgcagtgtttctatatttattttgtagaaaaaaacagaacatcaagaataagcaaggttttgtagtttttttcttcttcttcttcttggaaggaaaagctttaaaaaaactaccgtgggaagacattttcaccttcaaaatctctgtgagttcagcattaaaggagaaagcacttgattaagccatgtaaaaggtctatttcctacattagtctgattagaaggatgagctggggcagtttttgaatatacagatttcttggctccatccaagatgtgctaaatataatctttagggaaaagaaccagaaaattcttttttcttattttttattgtaaaatacacataccatagtacttaccatcttagccatttttaagtgtacagtttagtagcattaagtacattcatattgttgtgcaaatcatctccagaactcttctcatcttgcaatagtaaatatccatactttttaaacaacaactccccttttctccctcttcctcgtctcagcaaccaccattctacttctgtctccatgaacttgactactgaaagtagtcaaatataagcggaatcatactgtatttttccttgtatgtctggcttatttcacttagcataaagtcctcaaggtatatctatgttgcggcatgggttggaatttcctttttaaagctaaataatattttattgtatatatacactacattttgtttttctattcattgttgatggacacttgggttgctactaccttgtggctactgtaaataatgctgctatgcacatgggtgcacaaatgtctcttagaatccctgatttaaatttgtttggatatattcccagaattgaaattgctggatcatacagtaattttaattctttgaggaacctccataactgttttccacagcaggtgtcctattttacattcacaccaacagtgaacaagggtttcaatttctatacatcctcaccaacacttgttatttattttttatagtagccatcctaatggatgtaagaggaaatttggttttttaaacaaatagcttaggtgatttctatgatcaagcacattctagacaatgaatgatcagaaaatttaaaaagaaattgaaggctgatgaaacattacttttataagtttatgacgttttcctgccccattccctggaggcttcatgcacagtggggtgagacagcatctggaatttgtattgaccctttcccagaaatgccaaatggtgtgttgatttggagcttccaattcagaatctgataaccaggagtttattcagtctctgatcttacttgctgtgcttgctgtataatcatggtcttaatctttctaagtttgagtttcttgaaaattaggactaatgatatcaatttcccagggttgtttgtaagggttaaacataacaccacacctgaagtttatttgtttaattttttttgagacagagtctcgctctgtcacccaagctggcgtgcagtggcacaatctcggctcactgcagcctccacctcctgggctcaagtgattctcctgcctcagcctcccgagtagctgggattacaggtgcacatcaccacacctggctaattggtataagttttagacctgtcacttaaaaccttggtgatcaggatcttaacattgataagcccattttcttctctgtaaaatagggatagtaacaagaactgtctggttcctagtgtgctagttgatatctggtatcattctcctcttttttctctgtaggataacccagatgttatgctgaatatcaaatttcacagctgaaaaatatatatcccaatctccctcacaggcaggtgtggcctgaaagttctagatcttaataagcctcccagagaactttcctcctgcctatcatttgctggtaaaaatgcagatgtgaagactccagtagtcatcttggttcatgtagtactcttgaaaatggaagtcacacatgatgaattaattcctaatgatacctcacaagctctgggctgattattttttatcattttctttagaagaaaattaaactatttttaagcctctgttatttctgcactaacagcttaatgcaattcctaattgacacactacctcatagggttattataaggataagattagataaaacatacaatgcacttaaaatagtgcctggcacaaataatgtgctttaaaaatgatcaattttgtttaaacttggcttggattccataggacgttaacaaaaagatcaggctgaaagtctagattcttctctgtactgtggacaacatggttatcaatgagattaagagacaactagagtaaaaacaaaagaaaagaaaagaaaagaaaacaacagaagctctattaactgacctctaaccaatacaacaggttaactgatgttctccattctgtatataaaaatcccagtggacacccacaacacaggcttcaggcttgtaggacactttctagttcatctgagcacttttgttctcagcagttgagctgtatacttagcaacatttggtgcttccaaacccatttgtgcctgtagcacttactattgaaatacataatttaattaaatattatataaaggaatggaatacgagttggacaagaaaaagagttaaatctgaaggttaggtaaaaagagcaacttcttttctctgttttgcaggttggcaaaatcatttaaaaacaattggaagtattatatgttctgcattaagttgtcattttacttaaaaactaggcatcaaagatgatgcataataaatttagtgtatgcaagaatgactgcttgggacctcaatatatgaattcttaatccaaggaaagtccttggccttacatttaaaagtcggcaaataagtgtacgtttcattgattttagttagactgaaatgtatacaagatgcgtggatcaagttgtcatttattgcttccaccgagttttccaactaacctaccaactaactttcttgatcattttgaatgatctacagtccacactgctgcaggcatggcccgaggacaggtatctaaaacaactcaggtttgattgtgagggtggagaaagacacatgctctccaggctcacatgtggatcaagaaagaaaggaaaccaagaaaggaatttacatgaaagcaagttaggcaatgccaaacttccttcacaggcttaaaaggaaaagtgatctgtgcagatagtgatttcagaagcgtcctttgaagtgcttctgtttattctgcaggattttctcacttgcctcttgaaataacaacgatagtgaaccttctttccctgaagcaaaaaaaaaaaaaaaaaaaaaaaaaaaaagacaaacaacagaccttctcaaatcaaatatcactgtgtctgtggtttggctaaaggataccaaaagttgttccctagtgagacatgcaaggagggtagcaaggcctacccttttacgcagaaagatcagcgttaacgagaatcagttgtaaatgtgaataaattaggaaaacagccaggatattgtggtagatagttgccaagatggccttccagaagatgctgtttctaatattgagtagttgactgtaattcctctccccttcaacctgggctgtcctgagtgcttccttgaccaataaaatgttagagaagtctgaacttccaagactaggtcgtatgaaatcttgcagcttcctttagtatcttgcaatggtccctatgggctgtttcttgtcaaaagctagtctcaatgctctgagaagcccaagccacctggagatgttacgtgtaggttctccagttaacagacttaatgggctttcaggcaacagcagcatcaactgccagtcctacaagtaagccatcttagatgtgtccatccagcccagttgaacctttagatgaccaaagatgaaatcaagatactgtgttgttttgagccacctaattttgagtgaaagataactggaacagatgttgtcaagcacagtggttaagaatatgggacccaagtgtcaagactgggttgatgtgagtcctggctctgccgtaattatgcatgtaaatttacacagttccttaacccttctgtgtcattttcttctctatggtgggggtgataccattacctatatcatggggtggtccttaggacaacatatgattatactgcatataaataatataacatacagtaagattctatccccacaacaccatcatcatcatcattactattaccatcaatgctactgctactgctgttgttacttcttgtcagcttttagtagagagagagagacctttgaactgccttcatgaaaaagcccagtggaaaaaagaaaatggccacttggtacagtgcttagaatgatgccttgtacattgtaagtgtttggcatgtattagacatgattataataccaccttttttctgattgccaatgtccttggctaaactatttcagtactctaccagctaatcatgctttcaagatatgttctagatgctttatcatctctaaggcagtggttctaagaattaacccaactttaattctttaacatatgtccactcattcattaatgcattctggttagtaggccactggaatgtcagcaacatggcagacattatgatagataatagcaatatggcaaggctggtaggaagatatttaaaaggtaattgttagaagagcaagacacacctatgactgtgcacattacaataatctaatgtggtctaagattgagaggtatcaagaaactctttcctagccaagctaagacataaaggaaggatgagtagaaatatgtcagttgggagggtggaagggtgggaggttggtaatgtgcctggcagaagaatcagcctgagcaaatgtcctaagctaggaaacagcctggttccttccaggaaacaaaagtagacagagtgtgctgaatgggaaatgatcttgcaaggagcctgaaatgacaagtggagtactcacaaaggaccttccacaatcagaggaggatcctgactttatcctatttggatatataataaagtctttgcagtagcggaatgacacaggcagaatggttttgtgtttgttcatttgtttcttagtacagctttgactgctgtgcatagaaatagctgtagcccaggtggaagaggataatagcttgcccttgggagtgatggcatggatagagaaaaatgctcagcagtcattgctacaggaaaattatctccacctggtaacccactaattgaactttttccaaaggatccacttggatctgatgctactctggggagaataggtgacttccattactaactctttgcttgatactaagtacattctttaccaacgtagcttgaggcacttggtattgtcaaatagttaagagattctagatcagagtttgatcctagctgggcaattactggttgttgtataaccttttgcttctttttcctcatctgtcaaatgggcataaggatagtgtctacctcatgaagttgcaatgaggatgaaaagtgtgaaaagtatttataatagcacctggaatggagaaagtcctcaataattattatattattttgtaatcatttaatccacacatatgtattgagccaggcactggggatgcaaagatgaattagtcaatgtccccactctcaaagatacacctaggaggcagggttataaatcagagattaaacgtaagctgggggctaagaacaatgccacagctgtgcaaaatatgaataccaaattacaaaagcatattgttgctaagtgggtctgagtatctgcatttccttaaagcagagaaatttattattttaaggaaaaaagaccatgtctgaccttggctgaaaacatggtaattacagagcccaagatgtcactgaaaatgcaagacagcttgagggcacaaagatagttttccttcgaaggctgattcaagtagaggattagaagaaggctatttgggattataaaaattcctcccaaagccgtttggtggctttttttttttttttttttttttttttttttttttgagagagagagagaaaactattttagtggccaccatgtagaaagaaacatttgaagtaattcttgtgtatagagggttggctgccagcgtgattgactaaaatggtcttcagggactttcatgagtaaaggagatatattttttaacacttactgggaaatggagctttgaaagcctgtctccagcaaaagggatttttgacatgtataggctggggcctagaagtaaattttctctctcctacttttgcaacagtcttttccctttatcctggtagaaactaaagtagtcaacttcttgtcattaaaatggaactggagaaatcatcaaagagatacgatttttccttactcttttaaagcagcctaggtattaaaatatcttctgagatctgtgcagaattttcatttatactaaacaactcattttgtttgtcagggacaaactaatatgaataacaaatatctagggtagaatttttcatagaaactctttatatgttaaaagaaaaaaaaaagctacttactgcttattgatgcattcaaatcattcttaagcctgccattgccaaaatggcagactgaaccaaaccttgaattcttagtagagagggtatttttgctttttgtttttgtttattgtttggagctagcttgcttctttgttttctttctttctgtgttcctttcttttttttttttttttttgagaagacatgctacaaactaaaatttctgaattcacgttttaaatgtagatcataaatatcttcaatttaaccatgaaaaggtaagctaaaatacactttattttatgtatttatttatcttatgggcgagggccaggctgtgagccagtgtgtggtgagtgaaccccaccaaaaacacattttaaagttctagtagaactaaggtattatttgataaaaccccattagttttatagtagcagaaataaacgtatgaataatggaggtgatttttctaatatctcacaggtagttattagaagcaaagggcagttttgaaaatgtatgtctgtcaagattctcttggttatcagtgacagaaaacccaattcaaactgaatttttttttcttttcctttttttttttttttttaagaagcaggaaggaattgtagtcttatattcaagtaaagtccagggataaagcttattagtgagggaagcagactgcaagtacacgataataaaccacaggttttcttaaggcatagcctcaaatgatgccatctgtgctcagtttccatcccattccatcccatcttttggttgtgccttctactatgttggcttccttcctaggctctttgacatggctctaaacaactccaagctcacattttttctgggtttgagtgccaatggaggaaatctgtctctttaggtgagtcatgggatcagcttggtttgggttaatgggcttggcttaagtcatgttgtgttctaaaccagtgcttttcaaactctccatcatgaaggacctttttattcttcttaaaaaatacccaatctgtcatgggccgatacttttgtaaaatacaataaaaatgaattagcatgaaaataaaatgaaaggacataaaatataagcccaaattctttgtttttagacttctcagacataaaattccctgcccaattgttataaaacttcttaatgtctgtacttgttacagaccagcaataacaaacagataatcaccctttgaggagcagtactctaaactaggagtcagcaagcaacaatccactgactaagtctggtccaccactagtttttaataaagttttattgtaacttagtcacacccatttgtttatatatcatctatgctgcttttgtgatgtcatgacagaattgagtagctgtgacaatgagtatgtgacgtacaaggctgaaatatttattatctggtcttttatggaaaaaaaaaagtttgcctattcctaccctaagcaatcactgtgaccagaagatcacgatttatgattaatcaagatgaaggcacacccccacttcagaagttcatgaacagagagtagaaactagatgattctccaaaggaaattgagattcagctatcaaaagagggggaaaatgggccaggcatggtggctcacacctgtaatcccagcactttgggagcctgaggtgagtaaatcacttgagaccaacctggccaacatgttgaaatcctggctctactaaaaatacaaaaaaaattagccaggcatggtggcaagcgcctatagtcccagctactcgggaggctgaggcacgagaatcacttgaatccaggaggaagaggtcgtagtgagctgagatcatgacactgcaccccagcctgtgtagcagagtgagaccctgtctgaaaaaaaaaaaaaaaaaaaaagggaaaatgttttagggagccaaaaatctgtaaatatctagttccaaacttagatctttttactcttaattctctcatcttttgctgactctattgaaaattgaattactgtataaaatgaatactgcgaagtcaaaccatgccttaagtgaatgcaggtcataaccgaggcttgacagaatttgtcatctcaaatcctttgaggaaaaaagccacggaatatgcaaagcaataaataaataatctgaaaatgttattaaaataagagaattgataatacctaccatgagagtgtataaaataatcatacttataaaatacttacttaactctactttccagaaatggaaatgaaaactatttggaaattatgtttgtttaccaaatatttaatcaatatataccatgaatatctaaacactgtgctaaatgcgggaaccacaagagtgatgacagtggacaggtaagttgcagagagttggaaggatagacaaaactgtggtcagtggataatttacaaactgcaggttataattaggctattatttgaccatagccaaaaggagaagaaatagaaattagtaatgggggaatgaatctcttttagcaaggacagtatccaggagaaagtgatattgaagccatgtcccataagaaagaggaggagcaactagccaacagaagtgtagtttggacacagcatagagacgtgtagtgtggacatgcataggaaaagcaggtgccaaggccctctggcaggaaaatcttgatctcctccaggaaagaaaatcaaagtaagctagaagaaaaataatccaaactatttgggaggttagaaacccaatcattcaagctgggccttagtacatggaaattctttactgatttggcaaagtgagaaaaccttgaagggctttcaagcaagtggaggacgtagtttgatttactttttataatactatttttgctctcttatattaaatgagtaataatcatgatataatggttgcttcatagcaagggcatcattctaagcaatttaaacatattaagttacttaatcttcatagcaaccctataattaattctgttttacagataaggtttataattactctttttattgcttactcagaaaattaaatttgagccttcttgtgctttagaacacacagaaaaaaaaagactttcaccaaacacaaaatagttacttatgaaacctcagctaccatgcccaaatatactattttgggcattaatatcctaattatttcagaccattgatggattactaaaaattgacaaactgggtagaaactgattatttttctggaaacacagatgaatgtagacagtcatactaataatcacagacaatagacaccatgtcaatactaccaatatagcagattatgagaaattagagttatttcagagaggacccagttatttttttctgcttgcctattcccccctgattctccccagccccatgtacttttgatctgccacattcaccttcaccctcccaagtaaaacagctccttcttaatactctgagacacaatatgcaaagagctatggcatcatctataacagttttgaccaggtctgaagattttccccacaaaagacacaaaaccaagcattattctaagattctaaagtattgaagacatgtattcagaccaacactcttacacaaatgttcacagcagcactattcataatccccaaagggtggaaacagcccaaatgcccaccagcgggggaatagctaaacaaaatgtgatgtatccatgcaatggaatattattctgccataaaaaggaatgatgtatagcccaagtatccctaatccaaaaatccataatctgacctactctgaagtttgaagtgttttgagtgccagcatgacagcacaagtggaaagttccatacttgatctcatgtgacaagtcaagtgagtcgaaatgcagatgaacaacacacatagattatttagtgtccccaagggaaaaataaaattaccttcaggctgtgtataaggtgcacataaaacatgcgtaggttttgtgtttggatttaggtcccatccccacagtatctcattatgtatgtacaagtactgcaaaacccaaaaaacctgaaatctgtaacacttcttgtcacaagcatttcaaataagggatacttagcctgcactaaaatgaatgaacttgaaaaacctgctatgtgaatgaagccaggtgcaaaaggccacatattgtatgattccactgatatgaaatgtccagaataggtaaatccatagagatagaaagcaaactagaggtcaataggggctgtgaggagaggaaaatgatgatgcttaattcgaagagggtttccttttgggatcctgaaaatgttctggaattaacttgtggcaatgacttgacattgtgaatatactcaaagccactgatttgtacactttaaaatacttgaagtcatgagttttagttatgtgaattttaccgaatcgttttttgaaaaatcattcctagtagggaggcctttctgatgaaaacctattaagtttccatttctccaggaaagggcatcattttctaataatattttggaaagagagttaatggaacagcattcatagatttatttttatatttgaacaaaatgcttaatgctaagagaatgattaagtaaaaagatgatgataattataatgacaattaccttgatcatcatcattatattatcataatcatataatttggataaacttgggaaccacagaaataattaatccaatgtacacaaactgaattttagtgcatacctaattgactgcttttttggaggattatatatttttaaagcataatatacgtggagaagggacaagaaaaaggctaataatcacattttagtcttatttatgtataaccaaatataaagcaaagggtaaatatttccagccttggagtttgtatgtccccttagtctgtcgtaaacattattccataaggatctttctttcgcataaaacctagtccctcttgcccagctctctgagttgagccacagagaaactgcttgctagacctttgtgttgaaagccagcagggccccttagctgccatcctaacatgaattgctccaagcacaaattgttcccagagcaagcagtatgcatttgcctgcaacggccccatgaggggtctccctagactctggcatgcattcctggagcatcttaactagggctgataccatgatccaagcatgacagccacattgttcctacattgtctgccactggagctttaaattgatttgattagtttcacctggtccacacaggcacacaattgtaagagatctgcagctatccctgtcatgtcactatgtatcaagtgtcctcatatctgactcagccccttaatacagaaaaggaatcctttaccaaatcaaaattgtacctcacctttttcttatcccctcaccacaaatttaccatccaacctcttaacagttaagctaatgagctttaaaatattccccatctgcagcaacaaaaatatcaatgttcagtaaaagtaaaagtctctccaaaagtagtggggccaggtttcaacctgtgctatggtacacagatgtaccatgaccctttcaaagggatcaaagtatgatcaagaatgcaagttattcctgctaaaagtgaggagggtatctactcagaaacaagtttataagaaaaggttgtcagattgtaacatttgtgggcatgcagaatggtaagaacagagtgtgtcttgttgcgagtaggggtgagaagtatggcagcctattaagcagacaccaaagatcaaagcatgtttgctgaaatgtgcaagagctacctcctgagtatgtaaaactgcagccaggtcagtaaattgttctactcaaacagggacaaggtttcggaggataatcaagtggataataataagtaactgtggagagagaaacattttacacttttcaagtgttcaaccaaacacaaaaagttacaaactactgtcctgggaatagtcacatatgatgcaagctgtattcttccaaagtctttagctttttatcttttaacagcttctcttacactcactggcattgtgagcatggttgtaaccttataatcacattatgcaagtttaagggtcacattttaaattcatctctgttactttgtattacttttctatttctgcaaaccacattacacaaatctagcacttaaaacaatgcacattagtaactcaaaatgtttgtgtgtcagaagttcaggaatgtcctagctgaatcctcctctcaatgtcttaccagggtgcaatcagtgccagctgggctgtgttctcatctggaggcttaactatggaagattccatttccaagctccttcaggctgttggcagaaattatttccttgcagatgtatgactggggacccagcttgttcctggctgccagatggagcctgctcaacatcctagaagctacttgcaattccctgccacaagacccctcccacaggcagtttgcaacatggtggtttgcttcttcaaggccagcaagaaaatctctttagtctaccaagaaggagtcttatacaataaaacaatcatgggagtggcattcccatcactagtgccatattctatttctttttttttttattattattatactttaagttctgggatacttgtacaggacatgcaggtttgttacatagatatacatgtgccatgatggtttgctgcacccatcaacccgtcatctacatgaggttatttctcctaatgctatccctcccctacctccccacctcctgataggccccagtgcatgatgttcccccctctgtgtccatgtgttctcatttttcaactcccatttatgagtgagaacatctggtgttgggttttctgttcttgtgttagtttgctgagaatgatagtttccagcttcatccatgtacctgcaaaggacatgaactcatcctttttatagctgcatagtattccatggtgtatatatgccacattttctttatccagtctatcactgatggacatttgggttggttccaagtctttgctattgtgaacacagtggcattcccatcaccagtgccacattctatttcttaaaactgactcacaggtcctgcccacacttaagcagagatgacccaaggacataaatcattaggggtcaccttagggtgtgttcaacacacacacacagagacacacacacacacacagagcaaatatgctttatcagtttacaatccaggtttgttaccaggatctgaaagctggtggaaacactgtgtgggcataatcagggcaacgctgtgctccactggtatgcatttgttatggtctgattggtcaaaatattagtcattgaagcctgataactcaaggtgaaatagctgctctagcattgagaaaatgttaaatatattttaacatatttcatagaagacatttttcctggttgctctagctgagaacctaacaatgcccatttcaacaaatttgtcagatgaaatgttccccaaaatgcccttcttttcaaaatgactaaaatataccctttcatttcatttcatttaaattattctcaaaggcagccacagtgcaaatgaatcagaaatacatattgtatggcaatagaatattctacattatttttctgggctggaagggtgtttattatggcctcacgcaaagcctgtgatgcaggaaggtcttcgatattttaagttctgggccatgcatagcaaattcatagctttcctgctgccgttctgtccttctcaccagggcagacattgataatcaatcacagttctcttgctcgtgaaatctagacacagcttcagaaccttaaacaccatgccttaggcagccactagcaatggctggattagaacttgaattaaacctgctggccagcccttggatagccagttagcttattttaccatagagccaccactgggccctaaaactaaactaaagatgaaattatctgctcaaaagcaaatagaaaacatagactaatggagaaccatgatgagacaggatagggaaagagatccctactactgagacaaaaaatttaaaaggttatattaaaatattatttatttatatggaaaaaatgaaatatattattatgctttttaaattatataacatgattaccaggttgtcagatcagggcaaaaacagttgattaaaactagcgtctagaattcttcaccccttctcccctttgtagtaccttctacctatacttaagctgtgtttgcaatgaagaaacaggtattgttctattaaatgattatggagctcacaagatttttaggctctaaagttgttatattttcaataagacttggtcttgggaagcatcgtagtgtgataaagacatctttgagtcagacacttaggttcttagcatatctcactgtatgattttatgtacacctcttaaccaacccagacccatttctccacatgcaaaatggcaatgaagataaaatacaaaaaccgcacaacccctattgtgcttgggatgatggtgatagtatataacctaagtaatgagaaagtgttttgacctcacaagaaacatgatgtcatgttattacaaagtagtatttatttagatgtcagttctcctttgcaagatataccaaaaaatctaaacacgtgtatttgccagcccatgctgccataacaaaataaccatagactgggcagcttacacacaggaattattttgtcacagttctggaggttagaagtccaagttaagattccagcccattacatttatgatgagggctctcttcttggcttgcagatgtccatcttctcactatggcttcacatggcctttccttggcgtatgcagtaaggtggaagaggagttttctgatgtgttttcttataaggacacttatcctgtcagatcagggccccacccatatgatcttttttttttaaccttaattacttgcttactccaaatgctgccagattggtgattagggctttcacatgtgaatttcaaggggacataaacatgcagtccataactacctgaaaaaaatcttagtgttcagaaagacatcttaggtttgccctaaatcttttacaacagttattgaactttcactgggtgtcaaactcttcgttatcttatttactcttcttagcaactctatgctgtggatactgttagttttcctactttctatatgtttaggaaggtcaagcatcttttccagtgatcacacaactcatgaagtaaccattaattcgttcaacaaagatttttggctcctctgtgctaaaaacaatcctacatatctgagatgcatgcacaaataaggcagaaaaagatcttcatccttgagaaacttacattcttatgagggaaatcagacaaaaataacaccaatagacataatatatacaaaatcaggaaattatagtgcatgaaaaaatatagtagattaaggtagattcgtagtgttggaagaagtagaggcaagtaacaacattaaataaagtggtatagatagagttcatagggcaagtaagagttcagtgatcactagaagaagatgagaaggctggccaagtaaatgcatgagggaagagaattgagacaacagaaggaagaagagcagaggcccaaagatagcatcatggtgtgggtgtgtttgagaaacagcaatgaggccaagagtccaattctggtctgtctaacccaagagtccaacttggtaattgctgtcacattggcctccaagtgttgatgcaccattgtcaatctccagtctctatgataaggaaggaaaattaatattcattgagcacttggtaaatgtcaggcacagtgctaggtacttcatatgtattattggttgtcactttgattaccaaaattgcctggggaaattctgtgtgggttggtcccatggggaaagaaagaatgtatcaagttaattaatgaaatgtcatcagcacatgtggtctcattagagttcgtttcatgtccatcctaccctgcgtcaaggtagagaaaaaagcagctgtggaggtcattgaaggacactgacaagatttccgtcatggtcttgtctgtgtgtatctcctttgcaggcctgtctcctgaaatgcaaaattccactcttccactaggttaggccattatcaagacaaaactaattcttaattttacaggaacaacaaaaaacattcaaaatactatctggattttcatgtaaatcaagtgaaaatagatatgcttatgggcaaggactagtagaagccatgaaaaaaatggaagactttttgaagcatcactgttataatcacaattatttttaaaacccaaagcctcttgaaagggtaacatatcctgtcattaccagccattaccagctatgtaaaggtaatgtattagtttgatccttttcagataccagaactctctctgtttggagagaattacacaagaagagcaaaggaaagtccccagaacagacactgccagggagcagaggatgggaaatgcctcacagggaaatagtttcctgaaagggagaatgaaaaggggctgaagggaactggatccattttgctgaggcaactggctccagagtgggctattaccactaatttatgccctcttgactcaagctaagaaagactcatgttatatgtaacttcccaattttaagtccccattgtctcgggataaagttcaatgccattatcatggcttatcatatccttaatggtctgtccccatctctttgctccatgcttcctctcgggttcaggcatttgcaaagcctcatccctctccctgcagtgctctttcccatcctgctttggatcactgtccactaacataaatcttccttaatcactctcgtaggcagagtctgttacccctcacctctgctaccttagtatccattgctgtctttgcaataggacatattatactcaaccataatgtcctgttaacttggccatctccccattagagcacctcaagggaagggaatggacagggctttggccatcattgtatgtccattgcttaaaggacagaaagtagacatttcagaggtgaggattcaggcccaatcataccatcttgaactacaggaagcacaatgttaactctcccatctcctgaagagcagcctgcatcccttttaaaccagggagccactgtgcatggttgactgggtacagtatcacatttcccagttgcatgttttggggcaaaagcctgagctgtaagtctcggctgcctatgtagccaacagtccacacaatattgctaaataggttatattgcatctaaaacttagaatttacacactttttaggataaactgagactcaaaaaagttgagtgagtcaaatgagtgacatagttaattaacaacagagggcagatgtacactggggaattttgactcccaattcaatttcttcccactgtctcttttgcatagtaaaggtaaaatgaataaaacaaaaataaaaatgcaagaaggtgacaggtttattgggttctgcaaaaaaatgtaacaggaagacataggcaagttaattttcttgtttggctaccaggtaaatgtaagttagaaatgtgtcctctgatataaaccagctcattacattcctaaagattttacacgttttgatttctgtctgttcttgcttattcaaaagtacaggagaaaggtcagatatctattgtattgattttccagagtatacattaaagagactcaaatgcaaatgtgcctctcaactatgctagctattttcttgtccctgaaaggggaaaaaactcattagaacttttgcaatcgtactttatttgctttgcccattcaagattacacccattgctgttttttaaacaaacatatagtataaatatctgggtagcaataaatatggaaataaggctcagccttggtgtgatgaatttaaacatgaagtaacaggtatgaaaacaaatgtgcaaatactactattagcagacgtagttgccataagtgttattaacttaattattttcttagcttcagtagatttctaatcatatatttctactagcagacaagttgaaataaattatttcctctagatcttggctagaattacactggagaaggtaactagttttcttataacaaaacgataaaaacctaaactgtattgaattgagacaatccagtgtgaactgggtaaataccatgaggttttcatgccttaaaatgattctaaggtatatcttactttaaataactacatattaacagcaatttggttgaaaagtagtttaaaattttaacataatataattaaatatagattaatggtcaccaggcttatgatagttgaatgttttcctggtagtcttagttaccacagataaacttaatttcctgattgtaaatctctttattacaactgtcaacatcatttacttattcaaactaaaatcaaatatgttattttaaaattatagtagataaatataagtaatacacaatatttaattagatacttgttgcatacctggaattgttctgcatagtataaatgatgataatggccatcattatcatcaccaataacatagatagcacttacatatgacaagtcctcttctaaggtctttctgtattaactcatttcatatatcattacctcaacaaccctatgagataagaacattatgattatccctatctaataaaaagggcaccaaggtttacagaagttaaatcacttgatcaaggtcccttaaacctagatctcaccaactccagtgataaagttcttaaccacttcacttgcttaaatgcttcacgtgatgcacagaggagtgtaccaataactagacttatcgatttacttactaagttcaatctgtgtctttcatcatttagtggacttttgtatttgcttcccacaatatagaactgagatgcttccaaaatattactctaaaaaatagtaggaattcacttaacagtagaaactattttttcaacacaaagaataatgagccttttaaagtaatgtacttttaaaagaaaatagatgctggtattattagctgtctgcaattttctctacctgccacaaaaaatacagatacagtcctattaccatcttgcatatgtactgattgaagttcatgcaatggcctgtggaaggtccagggccaagagaattggctaataattcttacttcattctgtgctcctgacacaatataaagagcatgttatcttacttaatcagcacaacattgctgctaggtgggttttattccttcattttatgagaaaagagggtaaaagagttctgggtggttttttgctggttttttgtttgtttgtttgtttgtttgtttgtttgtttgtttgtttttaatgtccaggaccttataactactaagtgactaaaagtaggatttaagttaacaaaaaaaaacctgtttcttctggtgtcagaactcatgatcttgattacgttgttacatgaactattaatttaaaccttgagaaagtcctctttagaaaaaaattcacctttggagaactttgtccatctccacctttgtacatttttcaaagcaccagtgttctctcaggcaatttcaacaaccgtgcaaagtgggtggttctacatgtcatggatggaggtccatgttgtgtgtggtagactcactttacagatgagaatctgaggctcattaacatgatgtgattatctggagttctcaccaatatcgatggcaaacatggtatcaatgcccaggtttttttatgattccattccacttttcatccacaggtgcctccagagtggtgaacataagacatgaaaggaagtgaaagtcagatcttctaactcttttaggagtggtgggagtgaaggagtagtgagtttgtgccaagtgatggctaacaaatgccatgtagatagaatgatctgctgtaccagatcgatcaccactgtccaatagtactttctgtagggatggaaatgttctattctgtatcattcaatatggtagccactagccatatgtggctgttttgcacttgaaatgtagctggtatgactgagaaggaactttaattttatttagttttaattaatttaaatttaaatatccacatgtggctagtagttatcttatttgacagccatagtgttagcttttttagcatcaacctcagaagtcatgtccatatcttttctgtggatgtagaccactacctatttcataaagcctgatgcattcaaataagtccctccaaactgtgagccctaacatggttttacttgcctatttcctattgcctcgagaaacactaactcatttaatttaaaaaacaaaaaagactataaagcaggacaggtattacttccattttacagataaagaaagtaaaactcaggtcatcagagtaacttgcccattgagacataagctgatagttttgactaccatactattctgcttatttattttttctcaagtagcttttgatcaaactatacagtttttctttctgtttaggaattgtcttagtttttccagggtaccataacaaaataccaaatggggtggcttataaacaacgtctatttctcacagttgtggaagctggaaagttaaagatcaaggtgctttgcagatttagtgtctggtgagggccacttccccacaggtagctgtcttctctgactttacatggcaaaaggggtgaggaatctctctgggctctcttttataagagcactaatcccatttgcgagggctccatccttatgtcaaaaggccctcctcctaacactatcactttggaggttaggaattcaatgtatgaattctgggggaacataaacatcagtccattgcagaagtatatttggaaagattaaaatggcctttgaactgagagcccttctatatagatatggcaaaatatttttaaatgtggtccttaagcttatcttgttctttttgcatacctccaactttgaaacagtgcctttgacatgaattacaaatatgcataggtatataaatatatatgtgtagagagccttcctttcattgtttgtaaccatttacttctcattttacttttctcccccagtatggcttttcttggtttaaattctttcaggagcaagaaatgccattcaactgatttaaacaaaaagttttctggccatgaaatataaggccaaggcaatgactgacttcagacatcactatctctctctccatctttctattctgttttcttctacattgggttccatctcaaacaagctgtgcctcagtagtaataaaaatgctaccaacaggcctagttttatataacaccagggtaccacccagcaatgaaaaaaaaaaacgttttttcccaatatcattagaaaaaatcctggaattgaaaattattggttggcttaggtcacaagcctatttctgaatcagtcactgtggccaaagagattgttccagtttttagttgtatatgacagccccaaaattagtagtttgaaacaatagccattttattacatctcatgtttttattggtagcaatttggataaggtttggcaggatgattcttcagaataaacaagagatgtaataaaatggctattgtttcaaactactcatggacagaggtccatggtgttcagctggtgactgaattggttgtgaaagttcaaaatggctcatttaccttggcttgaaggagacagctggaaggctgggatcagctgggatgatcaactgtagcatctgcatgtgcacttcccagtatggtagtgtcagggctgtaggatttttttataggctggctcaggactcccagaaataagagtctaaaaagggtgggtggaagctgcaaaacattttatgacttaccttaagaaatcctagaatgttacttgggttacattcatttgttcaagcaagtaactagagccagcccagcttcagcaggagaggaatcatagttctcaaggagaggcatagctatttgttttttccaacagtgtttcagccagaaagagatggatgatctgattggaccagcctggtcatgtggccacctctgtttccaggaagtatggttagctccacctaaagcatctgactaacaccgtagggagagtagctccccaaaggaaaattaaagtattgttcccagaagagaagggagcagatgctaggtatgtagaaataagagctatgtgacaaattgatgttgacatcaccaagcctcatataataattctaacaagcattatgaaatcaaaaaagatatcaaaatgtggggtccataaaagcctgaaccttaaaccttgccattcactagcttgggctaattaaaatctgaaccttaccttccttatgtgtaaaatgtggataataatgatcttcttcccaggattgctgcaagcattagatggagtgctatacacttagggtttactcaacaattatcccctttttttccttatgaaacctcttaaactgtgaacacgagctcctcttgaaattagcaccccctcttagagccacctgaagcatagtagcctaagaagtttcaagtgtgtagaaaccaagcattatttgcaggctgcactggcccttacttcccaaatgcaatttacattttcactttgatcagtaaaagcagatatattggtctctgttcacatgagagagtacctctatgcatctttgcagtgacatactttcctatttcatctttgaaattcatttctctcacaatccaaagcagtcaaggtcactggtcctttaagaatattgtaggttgctcatcccaacccatcttgataatggaatttagggctgaatttagctttttctcttttattggtcatcactgataaaacttgattgcttaatattttttcctgagcatccaggtgctgaaagctgtgttccaaattcagcgattaactgtgtcttaagatactagattgatgacttctcagtctggtgcttttcatcaaggggacagtgtggaaactgagctgtccttcaagaaatgttagccttggtttgtacattttttaatgtgaatgccaactgaaaaaattaggctacatatgttgcagttccttcatattttatagtttcctttgtgtatattttcaattaatgtgcttagttcttgaattggatctaaataaaagtgatcttggattgaaagctatcaggatattgtgcagcattaaggagagcactggttctttctctctcctgctgctagaagaggcaataaaagaacaggagaggaagggaatgtttcgttgtgttcagtgcgtaggggtcataccactgctaaataaaatcatttcagataatagtacaggtgacaccaaatagcaactgaagtacagagtaaataaattgttccttctttttttttgagatggagtcttgctctgtcacccaggctggagtgcaatggagcatctcagctctctgcaacctccacgtcctgggttcaagccattctcctgcctcagtctcccgagtagctgggactacaggcatgcgccaccacacctagctaatttttgtatttttaatagagatagggcttcaccacgctggccagactggtctcaaactcctgacctcaagtgatccgcccacctcggcctcccaaagtgctgggattacagacgtgagccaccgcgcctggccaattgttcctgtttccatttccttctatccttttgctacattgaaggagaaaatctcaatttagtattatcatgtcttcaacacctctcaaaaatatattcatctccaacttcttaaaagaaactgaggatttcaccttaggaagacaatagtgtctaactataatcagtaatctttttattgttgtatttatttttatattgaccgcagagaatgtaataccagttttccacttatagtaaggtaataatgtttcctttttacataaagtcattgaattaaaagaatcagttcctaaaagtgacaccctttgttttagaagtcagatggagctcttttagtcatggccttatgtagtgcctttcaccctggctgcttgtttataaaccaagactacccagtttgtttggtgacctgggtgcagggaaagccgtgcaaatgtgtagtcaagtggtctgtaataagatgagcgatacaaatgctgaacaagcctcctctgggcagcatctgatagatttctgtactgaagaaaatatttgatgaggacagaccccttaatcctgtcaaacgaactaattcattttcagttccatctatgaaattatactccacaaaagcagaactatggcccaggaggagacagtcatctgacagagaaacagcattgctgagatgagatagaacttgctctggatcaaaagtgatcatttctattattctcatggtatctttgatttgtcacagcaattgcatttgtataaggcctagttaattaagactgtggactgtgatcaaatttaagcagcacagttcctaaaatatacccagccttatctgctcccacttgctgataaacacacacacacacacacactcacacacactcgcacacttttgctccagaaatgctgaactaatagttgccagaatacaacattctaactcatacctctgggtcatgcacaagcattacttccactgagattccctttctctactttactgcctttgcaaattcctactgatcctttagcactcattgcagacatccctttttcaacctcctctcaactctggattagatcctgcatcttaatagctgtgtgagcgtgggcatgttatgtagcctccttttgattggtttcctcctctctaaaatgagataatagtagtgcccacatccaagattattatgaggcttaaattatggaatgaatacaattttttttggcacagagcctgatccacagccaattctccctaaattctccctatgatttcaaagtattatttattttgtcattgccctgactacattgattgcaattaaatagtgtcctttattaagctgatagttttttaaggatatgcactgaaatttattaaatttgtcctcagcctcaacatatttaggaatataacatatttatatttaattgaactgcattgaattgcatctggatgagggcaactgatggttactgattagtaattactgatgattacttttataataacaataacaacagcaagtttatggagcacttactttgaactaggcattctgggaatcaaagtccccaaaccaactaattggctgtttcgttcacatctgaacccatcactgagatagggggaatggaacatgtagaggggttaagacaaggtcccatgaccacatggtttgagagagtgagtgaaggttgtttccccaaagataaacccaagtaccacaaccagagggaaaaaaattgggattactgctggggagaccaaaatgtcagatgagtacaacactggtttcagagtaatttttatttgtccataaagcctgcctcttggatcattccagggcaacaacctagcagttaatttaagtgataagattaaagtttattttaaatatcagtgatctttcctccattcccaaacagaatgagttgatacattcgtttatatatatcaaggtggttgagcttgttggtctataatacaatatgtaaaaggctaattagaatattgctactgtggtctgaatgtgtgtgtctcccccaccctcaattcgtatgttaaaacctaatcaccaatgtgatgatattagaagacgagggcctcatgtgagtggaatcctcatgaatgaaattagtgtccctataaaagagactccagtgaactactttgtctctttctgccatgtaaggatacaatgagaagacgtcatctataaacaaggaggcaggccctcacaagacaaagaattggccattgccttgatcttggacttcccagcctccagaattgtgaaaaataaatttctgtcctatataaggtacccagtttatattattttgttataatatcccaaatggacaaagccaattgttaatgattacctcatagttttgtatcaactactttgcctagtatgatgcatttcataaataaattcatatgtatgtgctataggctaccttatccagttcaggctgctgtaacaaagtactatagactgggtgggcttataaacaacagaaacatatttctgacagttctggagtctagaagtctgagaccaagttgccagcatggccaggttctggtgagggccctcttctgggttgtatactcttggcttctaattgtatcctcacatggcagaaagcagagtgaggtttctgggggacccttttatgtgggcactaattccatccatgagggctccactttcatgaccgaattacctcccaaacaccctatctcctaacaccatcatgttgcaggttaggatttcaacatacgattttgggaggacacaaacatttagttcataacatgagcttacatattacctttctgaattgagggggaatgttgttgaagaagagtttcataatgagatgaaatgaaaggaagtaatttgggtgtattccttcttgtaggaaggggatcgtatgaccaacaaaatcctaaaacacaaaacagtttgcctatactcagaatgttgcactggtgattgttttttttctttgggaaaagttgtcgtctcagaaagtaaaatgaaaatggtttttgagcttggcatttgggctagagccaacttgaaaattcagagcatgagaaaaaatttttttctttagacctgtcttctccacaaattatattcacgaagattttcagactctgtccctgtggctcgggctcaagtagagatagatttcagcctgccacaggtaggacagaaaatgattttaaaagaacaataaataaatattagaagccttttctttagttgctattttttccctttttcttttgatggctgatgttcagttttctcccaatttctttcttgtgctacagcaagcctcgaaaaatacttcactataagagcaacttctaaatgctctcgtcttcttgcagaaatcatgtcagaaacatccaaatgaatcttaatagttgagtaaaattgaatttggcttctctaggccataacagttagtattactccattgtgagcagatctggattataattaagaaaacccaacattaccactgacacagaagtatgctaggaaaatgactaatttacatagatctatgcctgttctgtaacttctgcatctggcatgctatgagggacagtgtgatcatgcatgtaaagtggagggacacatgataaggacagaaatctactctcaggattatctattagtcaactaaatttttaatattaatgcaaaatctcattcttcagtaattgttaatattcggtactaaatggctagaaaatagcagcaatctggctttggtgcagtcaaacacctggattcattcaatcatttagttattccacaaatatttattgagcaccttcagtgtagcataggattgtgttaggtggcaagtagcagaatgcccaactgaagcagctttgacaataagaattgattttttcctgcataacagaaagtaaggaggtattggtttttgacataagtgccagccttgcagcaattttcctgaactgtcttttatgatggctatagtagctgcagctgtcatatacgcatttcagactgtgtaagtaggtgacttaaggaccaggccagcagtgactttgtcttttcagcaggaaatcaagacttttccagagcgccctccccagcagacctttgcttgctctcatagaccagaatcgtatcatatgcccaaactcagctaccaggaaagctagtaaagcaattattttgaagttccgctgctggagtgggaagtatcaagggagaaggagttgggaatggcttttctgtagccaatttacaatgctggtcacaatttctatgtgccaggcactctgcttggtgcattaaacacacaactggaaatgtacaatcactggcctcacgaagcgtacagcttagtggagagatagatgaggaaacatttaaaatacgtgaggaaataggagcacaataccatagaagcctaaaagaaggaagacttaagtttggtttagtgtggaattgatcaagaaatttgtacagtatcaaagtataccttagagacagttatttggcatgtggtttatttattcctcatgcaaatgattttcttgtatttgagaaagtcagtggtaaactaaatcaagtaacaatgacacagaactcataagggatagggaaggaaaaaacctatagacagtttgggaaaagtgaaatttgtttgcttatgttgtgacagaaacatagaagtgagtctgggtttttctgtgtttttttctgttttttttttttttttttttggagatagggtctcactctgttacgtaggctgaagtgcagtggcatgatcatgactcactgcagcctcaaatgatcctcctgcctcagcctcctgagtagcaacaacaggagcacaccaccgagcccagctaattttttattttctatttttcatagatggggtctcgctttgttgctcagggtggtctccatctcctggcttcaagcaatcctcccacctcagcttcccaaagtacttggattccaggtgtgagccaccaaaatatcaaaaacttttcagttatttataaatttttctagaatatcctgagattttagctgtggattgaatatgataggctgattttgtgtaatgtcttccagtgtctttctgtctaacttggtgagatctgatataaatcatttcctcactacaaattctcaatgagaacacgtatttggattgagattgtaagatgtcaaaagtctctactcgatgggccagtggaaggagagcagttccagtggtgttagcaacatacataaatgtgcagagaaatgatagggaaaggttcggggagctagatggccattccgatttactgaagcagaaaaagaaaggcttccaagtcttcttctagtcaattggactggtgcttcagaggcagcacctaagtcaggctctgagtacatacataaaaggcacttgaggccaggtacagaggctcatgcctataatcccagcactttgggaggcctaggtgggcagatcacttgagaccaggagttcgagaccagcctggccaacatggtgaaaccccgtttctactaaaaatacaaaaattagccaggcatggcagtgagtgcctgtaatcccagttactctggaggctgaggcaggagaactgcttgaactcaggaggtggagtttgcagtaagccgagatcataccactgtactccagcctgggcgactttgggaggctgaggtgggcaggtcacttgaggtcaggagttcaagaccagcctggccaacatggtgaaaccccaactctactaaaaatacaaaaattggcgaggtatggtggtgtgcacctgtgatctcagctactcaggaggctgaggcaggagaattgcttgaacccgggaggcggaggttgcactgagctgagatcatgccattgcactccagcctgggcagcaagagcgagactccgtctcaaaaaataaataaataaataaagcacttgaaagaagtgtatgtgtgtctatgggatgagtgaatggaatgccagggatgatagggagtggcagggactatggcaaactggagaacatgaaccccacccaaaggagaaaacactgctcagttgtttttataaacacgcagccccagtgttgctagtcttcctatttttcccagaaacctaacatttgtactttaatgtaaaatctcctaatttgaatattggtgattaatttcaattattaaaagtactgtgtagagagaaaaaaagaatccacacttcagtttaagcacataagctgccaacttttgacctttgtgttaaataagtgttttgtaatttcttaggatcaatttgactggagaacaggacatctcctttaatcaggaaagtgagtagtcaatgatcaagaagccatgaaaaaatgccctgtcatcaattgcttgattcttacatcagtgcttttagaagcaaaaactcataaatatagtatctgaatttgattaaaataaaatatcccccaaaatatatatactaaaataacactcttaataactattcagtataatagatcattttcatattcctagtgttttgctatttaagtgtattatggaaaagattgtttttatttttcttttcaaaggcctaggttttctttgcatgtactcttgcttcccagtaaatccaagggcaaaatgcatttatagattggggtttgttgttttggatttaggtgcagaatacccaacattttatgtcatttttttccaaacttctgtcagtctcataccatcttcctatttcgtgctataccagtacattgtctttatcattacttgcttgatgcttttctttaaatttacctaaatgtattcatcttaaaaagatattttctgactactttcccattgccttttgttgtataacaaatctccacacactgaatgacttaaaagaacaaaaatgtaccatttctcacgattctgtgtgttgcctgggtggtttcttctggtctgggctggctccattggacctggaatcagggtggcctctgtcacatgtctgatgattgacaggttgatgatgccaggaggacctcagctggggtagctactctctgctccacatgacttttcagcatggtcacgacaggtttctaaagagcagtaagccccaatacaagcaccttcaaatctcttcttgtctcttgcttgctaaccttttattggatgaaaaaatcatataaccaaacccagatagaagggctggcaaaatagactctacttcttaatgtaaggacaggcaaagtcagtgcacagaggcaggtgtagaagaggaagcatttgtaattgttcttacaatcagaaaatagaaatttagtattacctgacataaagaggcagtacatttagaaaataaaatcaaaatgaattggcattattaaaccactattgctagaaaagtaaggttttaagctaccacaagattccccatctcccaggatcctgagccctcagattgggaagtacttttctatgtttctaggttgttttttgtttttgtttttgtttttgtttttttttgagactgagtctccctctgtcgcccaggctggagtgcagtggtgcgatctcggctcactgcaagctctgcctcccgggttcacaccattctcctgcctcagcctcccgagtagctgggactacaggcgcccgccaccaccccctgctaatttttttgtatttttagtagagacaggatttcacagtgttagccaggatggtctggatctcccgacctcgtgatccgcccacctcagcctcccaaagtgctgggattacaggcgtgagccaacgcgcccggccgtttctaggttttattgttgaactttgggtatgtgttccactcgactttcaatttagctaaatatatagccataaatacagtcaaaagcgtaggggatgtgcagctcaaggcagtagaactaagatgttgaactttttgcaaacagatccatctgaaacattgctgcatgtatattcctggtctcctttgattatttttttagctttcttaatgccatcactgacacgaacaaaatgaatttcgaagcgtcagtatggaattttattttttacccatgtttgttggcagttggcagattcattctggtttagcgggtttgatattagtgaaattacatatttcaaaatataagaatccttatatcatccttcattttctcatctgctttaaaactcataggtgaaggctctgctatgcttttatatagttcagtctgcctattttaagtagtgctgagcatagagcaggtggtctataaatattttttctgataggtaaagctaaattcttccaaatagtccagacaattccacaaaaataaccatgctagttgtgtggtattgtataggaaaacaaagctgttgattgttgttttccactttttaagaggtgaaggtcaaaggcatattccagagatattgggaagttcttgccaaatgactgaagtaatcaactatcaaattattttgccatttcaaatatagacacacatcaaattagtttcaagagtgctctatgattaaggagtccatatttcatcttcacatgagagtctagttatgttttttgaagttaattacagcaaacctgaagatatcagtctcccctagagactgcaagagcacaatggtattatatcctgttattctctctctcttttttttttaatcaaacacctgtattaacacattctcaagtgtctgtgagccaggcaaatagtgctgagaaccacaagcttttcatccagaccttagtcctcctgagttttccatgttctcagttgtgattcactcagccacctatgacagcttaataaaataagagaaacaatgtatctcctttgattccctaggatttggcttctaaggcaataggtgagttcagagttaagagacacttctctcctagttggtatcaatttgtatagatctgaagtggcctaagaggttttgcatgctctgtagtttctcccttgtctaaagtttccatcaatgccaagagcatctccctgggagtttgaacttccctttaatctaatccatttagaaaatgactcacaattcattgaatgaagtagagaaaattgataacttttcattagtctgacaaagtctttttcagtgctggcatctaaaatgtgttctctatttaaattttatttatatcaatcttctctagtgggagtaagattaaaatgaaataccttacaatcagtgtacaactttcccattactgccaaaattgtgaacactagttttgcaaatgaactcaataccaggaattttctgagcataatttaatatttgagatcaactgcacagtggaatcaaccaaaagtgatattttaatacctcaataactataaaaatgattacatataaaaagaggaaagagtacttaactgacattatttgatcatggtaaatttgtagcaattccagcaaaaactatattatagagtctaatagtactctcataatgtactttttaaaactggggaaatgtttgtatataaactcattccttcaaagagccatttctaaagtttaagaaaaataccaaagtgtaaaagaatgcctctgccaaatggaatcatgagtgataattttttaaataattatccatatgctttaaatgttagaaaagaatatgtattactttcagaattagaaaaaaaataaaggttttttaagttggcaaaataagaaacataaaaaacatttgttcttcaacaaaattgcaaattactatccactgtaaataaactttagggtcactcttaaataatttgaaggtagaatgttaaattttaagatacaaggtatatacagtaagacatgtatttaataagcatgattccttgtgttccttgctaaccatttattaaaaattatttttctacacagatgcaaagtcatgtaaagctgaattctaaaataaaaccatctatttagtgaaagcaagaccaacattcaggatttgatttacaaatagaatcagggataaagttaccacagattaaaagtatagaataagccagggactccaggactggtatgcagcctaagacaaagagtattattagtggcaggaattaggagagcttccttgagttgcaaaaggtctctgaaaattccttgtcaccagagcatacagcttttttcaaaataggacatgtacccctgtgttccaataagacagcttagagtagcccataacaggtaaaagatttctaattgttttgtgttttattttaaaattcatgtcaaggtagccttttatatcataatatatacttacttgttttaatacaaaaacagttttgttaattacttaatggttaaattacttcatcaatgaggagtcttcttatggtcacactctgagaatctaaattatatccactagttcttttctctgatagcatgctgtatctttttatgcatcacaacttgtcaatatatattgtctggtctttatatttggtgcagagttccaaaaagagactgtatgctgctttagagtgggaactgtgtgtcttgattttatgtccagcactgcagtaaatgattagcttttgaatgaataaaaaataacttttgtctcaaatacctttaaaaaaaatctaccgactgaaggaaattataccacatttaacttgtgactttcaatcctcccatttcacaatccatgtcctcccctctaccctcaccaagataagattgtctgttcgaaaagcactagaatagaatttgtagagggaatgcaatcctaatgaatcttatcatcagcccttaacttcatgtatgtctttgaaatataatgtagatcctctaaagaaatacaatttgagctgtaaaaaatgatcgtatgcatttcagaattagtataatcttgcattaaagataaggcattaaccctgtatgaaggtgaggggatggatgcatacagagctggataataaacacatggataaataatagtgataactgccacatgctgagtataaagtttattaggcattatggtaagtgccttatctaaaattcacgataaccagttgtgacttttaacttcatctacaactgagaaaacttaatcttgaactaagcaattttccaaagtcatactattacaaagtggtagaactaaaattcaaacccaggtccctctatcgcatacccaagagtttagagtcttagtcaatacataatgtctcaaaattggatcctatccttaaatatgtgctcatagaaaagcgaagtttgaaataactgcagggaaggttatccaatgcctttaatttcctgtttgctttgataaagacaataacacactgggagtcactacaggtcttttgaagaaaagagttgtaacagctgttccaacaaccagtgcaaaaagggaggctggagatctgtcccatccttacagtggagttctagccattgctttaaattgcatgacaggttgcacaaaagtaagtctggagatttgtcttgattgaggtacttataacctacttctgggaacatgaatacaatcatatgttcaaccatttaatttatgctcaaactctcataagtcatagaagcaagctgagagtttggcatatcgaagaataatgttttactctcacttagtgaagaattgcctttttggtttggcatgattttattctttagagtaataaaattgatgatgccaatgaagataatgatagctaatatttattgaagatttactgaatgcccagtactctgctaagtacttcaaatgtactttctcatgtaatcctcacaaccctttgatataggcactattttttttctctttttgtttcattgtgtttattcattcataagttggaaatccatcttgacctaccccatgccactcaaagattagtatagtattaatcctactgttaaggagttcactgcctagtacaagtaggcaagcagatgagtccagtgtgattggagtgaaagctaagatgaccgagttactggttaaagtgttcctctgttattcctaacgttgccctccaccctgcccttcttcacaattctagtgcaagcatgtaaaatcaggagcttatcttttctctttgagtttagtgactcttaactagcatttcatctgcttcttcttccatcttacacactacaccaatgcatcttcccctacctaccctttaatcatatctcccctttgctcatggaatctagattcaccattctctaaaaaaaaaaaaaaaaaaaaaaaaaaaaaagaacacaagctgcttgctttcaagaacttccatagtcttattaagcctttgtcttagtctgcttgtgttactataaaagaatactgcaggctgggtaatttataaataaaaaatatttatttggctcacagttctgctggctggaagactgggcatctggtgaaagcttcaggctgccaccactcatggcagaaggtgaaggggagctgtgtgtgcagagaccacatggcagagaggaagcaagggagagaggagaggtgccaggctcctttaaacaaccagctctcgtgggaactaagagggtgagaattcactcaccctcccctgtaggggaattgacctgttcatgagagatccacccgataactcaaatgcctcccattaggccccatttctaacattggagatcaaatttctacatgaactctggagaggacaaaaaatccaaactacagcaggttttctccttttattccccaacctgagcctgctctattaacacaacatatttactaggggaagagcactttgctcatttatacttctttcctgtaatttatgacaaaatgccagtaacctgtattgagaaactctgatctaaactgtcatctttgaggacaggactatgtcatgttctttattttatcactcttggtaaagcaggtaatgttttgataaacatttgctgaatttgattatctactgaaacagtagaaagggactgcagttcttagtcaatataatgtttatttattgttttcattaagcccattgcttattagtatcttgctatagttccatggcaaaatgcctcatgagtgaacaacaaccataatgaaaaacagatttctgctctatttaggatttatactgaaataaaggattgattctccttttacagcctctcttttgctctatagcaatatgacctagtataagggaaaaatcaagactcatgattaaagaagctttagtgattttaagaatctctcaaagaaagatgaacattctggaaagagttgaagatcaaatattttcctaagcatggcaaattcacagagcaagtcctagaaccccagggttaaaagggaccttaaagatcttctttcataatcacttcagataagagaagctggttttggtggctgatatttaattaactcagttctaggggataaaaagtcctcggagcagttatgcatctacctcacaagtttctcatggcttcgaaaatggttcacttgtgggaatttctattaaaatgctgtaactagtgaaatcaagtaatgagtagctcagatcaaaaaaaaagtgtgataagttggctcttgcttgaattttttttaaagctaacttaattttacaagaatctaaatgtttttgttttctgcaagtatttgtgtttgatatgaaatttattttcgatagtaatacaacatacagaatccatggactcatggactcaaaagccaatatatttttttaattctatgaatgctgaatacaaaactagaaggcactgaattagcattataatgattaacaacaacaacaaaacaaaacaaaacaaaacaaaacaaaacaaaacatggatttggtggggaagcaagctggggttttagtgttaattcctgcacttcctacctgtgtaagcttgggaaagttacttagtctctccgggcttcagtttcatcacttttaaaatgggttagtgataatacctactttatagggttgttaacagcagcgtatccatgtgggtctgcagcagcctcagattctgcctcctcagaagaaagaatttgaccgaatgacttaaagcagagggagagaacaaggcaagttttagagcagaggtgaaagtttatttagaagtttagagcaggaatgaaagcaagtaaagcacacttgaaagagggacaagcgggtgacttgagagatccaagtgcacagtttgacctttgacttggggttttataagttggcttacttctgggtggttgtgtcccatctcccctgattcttcctttagcggggctgtccacatgtgtagtgacccgccagcacttgggaagttgtgctcatgctcatttgaggcatttttcccttatcagttgagtgttcctagaggaaggtcagttaaactccatcattttgcttcttagagcacgtgcttgaacctactcatccaactcctgagatcttatggggaagctgctgatcaccagcttcaggtgttttctatctgttgggagactgcctttccctggcgctggttgtgaccaattattattttagagagacagtttaacaagcacctgaccatcaactgatggttgccaggcattcctggtggggggccctctcctgccctgctcatgtcaacctaactacctgctctaacagagttactgcaaagactgaggtaatacatttaaaatacctaacagagaaacacataggagcactcaataaatgttaattatcctttttattattgcattgactatcttaattcaaaatatttaagaattatttatctttatatttttcttatgcagggttgaggagaattttcttctctctgaacgtccaaatctgtctgttaaaatgaatggacaacagatccacagaggagaaagtaggcaaatttattaacatgtacatagacatgggagtcccacaaatgtgagacccctaaagagctggatgactgaagattttacagcaccctgaggttatagaaagaataggggctcgggtcttcccaggaggaggaggggaggtggtgtcactggttatgggaaaatggcagaggcaaaacctggcaaagaaaggctgccttcttatgcagataaaagcccctcaggtatctgggagcactctcagaaagaataaatggtagcctgtggtaaaagtttctctgtcagactttaaaagtgtcagacattgagtctttttttcggaggggggatggagggtgggcagtgctcagagaaagcccatttgcatccactcttcactaatgtagatttcttgtttagatacaaatcatccccaaaaaacacagcatttcagagccatttctgtgtctacagcccctctgagtagccatctcaaaatataccaaagaagtagttggggagggtgcatatttgggtttccatcacttatcataagtatctccatgagacaaaattgtaaaaacagttaactagcattgatattagctcattttattaaatctagtggatcaattctctttcaataacctgaaggttttcaggtagctttcagtttgggtgaagaggaggcaattttgaaattctctcattgtaaatttttttttaaattgcagaaataaaatgagtttatgaaaaaattatgtttagagaatgtagctttgtaaagcaaaataataataataataataataataataataaaagtctgacataggtctcaatcaatttggaggtttattttgccaatgatgaggacacacctgggaaaaagagacaccagtcaccataggactgtggcctgcactttttccaaagagggtttcgagggcttcagtatttaaaggggaaaagtgggcagggtggtaaggagaacaaaaaaaaaaaaaagaaggaaggtatgtagtaaggtgagcggtcgcatccttatgatgctgtattagtccgttttcacactgctgataaagacatacataggactgggtaatttataaagaagaagaggtttaatagactcacagttccatgtggctggagaggcctcacaatcatggcagaaggtgaaaagcacatcttatatggtgctggacaagaaagaatgagaatcaagcaaaaggggaaatcccttataaaaccatgagatctcatgagacttacttccatgagaacagtatgggggaaaccgcccccatgattcaattatctcccacagggtccctcccatatcacatgggaattatgggacctgtgattccaaatgagatttgggtgggcacacagccaaaccatatcagaggctttagtgagtgatcactaaatctacatgttgcatgtgaaaggagcaggcagaggaacagtaaagtatggattcgccttgtgctttcagtaaaactgcattttacatgagataaagtaaacatagagcagaggaagaagtctaatatgcatttgtcttgaggtggggagaggatcgatttctactcctgtctttgtcctgtacctgtgaagataagctgttaatttacattgtcagagtgagtgagaccatgcagagagacatgtggccttctatcttgcacttatctgtttagaaacaaaggatttgtgtttgtgtgactcagttcgcaagctttacttttccctttggcatagtgagtttgtggtcctgagattttattttcctttcacaccttgacctggaatataaaaggatatatatgaagatggccatgtaacatgtcaatcagaaacaaaattggtctaatgacatcttcagaaaggcaacactgtgaagaaaactaaaatattttacccgtatatatatgtctttgacatactttgagatggttgttcagagggcttataaacagaagtagcccccaaatctgtctctagtggagacgatttgcatctgtagaggaaaaaaaagtgaactaaagaacagatgcaaacagcttttctctgaagcccccaccttgtcagtatttagaaaagattgactgagggtctgacacctggctgttctctctgagggctgctacctgagaagtttcatctgcataacaggaccacctttgctagccaaatttctcttcgccttcttccataacctgttccaagcccctattctttctgtaagctcaagatggcataaaaacatcgataatcttggctttctttgaatttttatattttgaatgattcttttgcacatgtgtgcacataatttgtatgcctttttttcctgttaatgtttatttttattttgttttatagactcaaattagcaaatctgcaggtttaaacttctctacaactggaagaatgaattggattctagtaagccaaagggtaaagcaaatcatccaactctatttagaagaggcaactctaatgtgaatttttagatattataacagttctgaggacgtttttcttcttagaaagcctcttcttttccccctatgaaccagtggatctttacaaccttgaattaaaggtgatgcatgggtttggagatttattttttccctaatgtctacattttcatttaggaggtattaatgcttaagacaaaaggaaactgctttgttaacttgcaacaaagtagatcagctccaagagggcagagagcagcctgaaggaggaggaggaacagggcttagaaggaggcaacaccaaaaaaaaaatgcaaaaagctgaccccactggcggatgtgcattattcgctagcttctgtgaaaaaaagggtgacaaaatgctaagttgaagggttgttgggaaaggcaatttcttctcatgctaagatcaaagggtttccattcttgatggtttagattcagggcaacaatattgaaatattaggtggggtttaagtggataagcatcagaaatggtagtaaatgtaactggactgtttctgattaagtgcttgcccaaaggaaacttcagattataggttttcaataaacactggcaaaccttgatttgtgtcttatgtaactgaaagttttacaatatatttttgttccctttcaatagtgtatgtttttcttgcttctcttatgtaatattgtcatctgttcattcacataaataagtacttttacccatgacaagaatcttcctttacttcctttacttcatgcccagatacagagcactgccatcaaaaagaaaaaaaaaaaaacaactttaaactctcaatcattctataccctgtggaggatttctgtcttctattcaaactctgttttaccataatattacgttgtcttacatatgaatacagctatttagaagattttaccacctatgcttgctggccatatccagtggaattgcatcatacatactttggtctggtccacatataaggcaaaaattaaatatggcaaaattacccttgagaagtttcttaaattgacaatataatagagtagacatgactttgcatatagaatcctactgtcgacctaaagggaagagcctgaagcacaaaatgtaacttgaagagtttatttgaaccaaaataaggatagctgcctggaagactcagaccatagtaatcttggatatgagctctactggccatagttaaaagcaggtttttaaagggggaaaaatggggatgggggaaagtttttgttaggaactctcattggtttacagaaataacattcattagtgattggctatccattgttaagctatagggcatgggatatggtgtccactgaggcattattaggttaatgcatagctatttgtggcaattgcaagccatctccttagatgaatgtgtgtctcaaaacagaggaagcagggtgtgattgctatctcattttacacctccctgggcctaataatttgaaaaggctcacattcctcacataaaagttcttttctttcctcactacataataattttattcaaagtaaagattgaggaacactgaattctaaagaaggggaagactgaagtaagaaaagcatagaaggaaagcctaagggcagagagatgtctggatggttaaaccattctgcttttaagtcagcaatctcatccctctagtgaatactggatagagagagaattttaatgtgctcctgctttgcttcagggtctactccatcccgttttaatgttaatcctctgtgacattatcatatgtcatttggcttctttgtgttgtgagacttaaagatcatggtggagagcatctttggaacatgggggatggaggggagtgagtaaagaacgagggttctcgtcccgtgtaaaaacagccaaccagaaagcatcgtaagacaaacacctggctgacattttgaggattctgaatgggaaatgcccaggtggatttgggaagagctaacacagggaggagctacagaaatgactggtgcttgtgtagaaatcatttttcaattaaggcattaagggaaatatagagtttcttgatttgcattgagtgaatctagtcactggttttataaaattttgttatcagaaaatgtgtgctgtaaatatttagtacatacactaaattcattgccagcttcctattgtggtcatccttgatattcccctgaaaattagggctgctttatcagaggctcaacttttgatagttccccccacatcatattaaacatattaaaaggtaaccacaactcatatcaactatactcttgatggtaaggatatatttttatctaatattactcttgacttttattttgcaacttttcttttgtactttcagtcaattcattttttctatgccaggcctttgaaattcttcaaggccctaggctaggcgataaaccctaatgcttggtggataaatttgcctttctgagaagaatgcctcagtcattctgaagagtattgaggcatttgtccccttcattgaatagaaatagtgcaagatctgtgctctacaaaagctaagagcacgaaagttcctgaagacccaaaaattaagtgtagggggcaaagaaaaactccttcatcttctgaaattttgatgaaaaatcaatgggcaaaaggcaggttaataaaagaaaaggcatacaaatttattaatgtgtacatgagggagaatcacagtgattacactaaccccctaatggcatataaaaacttacatactatcttgaaacttcataaagaatggggactcagtgcatggcccaaaacaggttatgatggtaaatcaggttatatggcaagacaggttagggaagggagagaaaaggaggcctggctagcaacgttggtctcacaggtagcagccctcagagaaaatagctggtaaatatttcttttaggcctttaaaagtgtcagactctcagttaatttttcctagactggacaatgggggcttcagagaaagcctggttgtatcagtgcagattttctttatagatacaaatctcccccatgaaagaaaactttgctggactacttctgtttgctgactctctgaacagccgtctcacactatgtcaaagaagcatattttggagtaaaatatttttatttccttcataagtcttcctcttccatatgcatttggcataaaaacaaaaagattgttttaattgcctgtgggttcttcctgtccactgtacagacaaaaactaattcactgagaccatgatattgcagtaaagaaagagtttaattaactcaaggctggtcacgtgggaaacctggagttatcactcaaattaggctccctgaagtcttcgaggttaggatttttcaagggtagtttggtgggcagggggctagggaatggggaatgttgattggggttgaaatgatagaggtgtggcaaacagttctcatgtgctaagtcagcctccaggtgggggccacaggactggttgggtcctgagtgtgtgggtctcagtggagtcagttgctagaatgcaaaagtctgaaaaaatctcagtcaattttcagttctacaatagtgatattatctacaggaataattggaaaagttacaaatctcgcagcctccagaacagtagctgattatcatttaactacttctatatcttaagagaattcagccccctctcatagtcctaactttgtggcctttcattagttttacaaaggcagtttacttttgggaagggttattattatccttgctttaagtttaaactaaattcctcccaaagttagcttagcctatgcccaggaatgaccaaagatagcttggatgttagaagcaagatggagtcagctatgttaggtttctcttactgtcataattttgaaaaggcagtctcaatccccaacaaaaatgctgcttgatgaaaccagtccacataattatatttgcattataaggcatataaattaaaatcttatttttttaatagagctttcttagctagtcatggaggattaaagagaacttagtgtgcttccaagaacgtgaaaatctgcagagggacacaacgtcagtgttcaggttgtttggatgaattgcaaacacagttgtttcctgtttctgcacagcctccatagtgattgggaaatggtggtgtgagatggagccttgcctagaaggagaagaatgtaagacactccctgacaattctggatggatgtgcgcaacaggcaacaaaattaagaccacgagagtaagtgcacttatttcaaatgtattttggatgttacagactgtactatttgagtttgtgctgtgcaaacagcatccacagaagctttgcacaggagagaagattctccactgacagaaagcattctgaactatgcagatcagtgtccatccgtgaatgagacgttagagattgaacttgactttcccacactgagcagtttagtgtttctgtcacagactcataaattaagttgggtttccagccagagtggagaggaatcatgaggtaattattcggataattcatccaacatttataatgctcagaatgataatcaaatgaacttcctccctaattcatccagatggtttgctgaaagggtctgcgtttaagtacacctacagaagccattttctaatgttctttaaaagagttctgtgatgatccgtcagagaactgaaaagggttttggggagtgaatacatcattctttgatttctttggttaaatcaggagtgatcttctaaataaataacaatcttcagggtggggtaatccaaaccatcaaaattggcacccttatgctggagcagggcagaaaggcccagctagctagatattaaccctgtagttactggacagccttggaatcctaaaggggacaggggtgggagatgctccggatgcttaagatagtaattatatatccactaataaaaaagtatgtctatttgacaagtgtggtcatatgtatgtgtatcaattgagtatcagccctgtttctctctctctttgtctctctctgtgtgtgtgtgtgggggggcatggggtgggtgggtgggtgtgtgcatgtgtgtggtggggggagggggtgcatgcctgtgtgtgttttaatttacaggaatttttcttgagagaggggggtctcactctgttgcccaggctggagtgaagtggtgtgattatagcccactgcagcatctaactcctagcctcaagctatcttcctgcttcagtctcccaaaatgctgggattacaggcctgatccaccatacccagcctgtggagtattttttaaagcaagctccatcggttacaaatcccagtatgctgaagttttattctaccaaaggtctgatgtatttgaaaggatgtctctgtttcccaccccttattattaatcttgacttactctttcttctcagcctcactttttcagtgaataaaattggttctttcgtctttgtgatgcagaagacaaaactaatgctacataatactatataaaacttatttttcacatataaaataggtgaaaacatcttgtgtatcaaatttccttgccttttttgacccccttgaccagtagtaaatggctatacatttccggcttgcgaccaggaggaacctctgaaccaccctagcttgctaacatgcatctgtctgtgcctgagtagcttaatgtggattatcctgtttcattttaatgaaacacctacaaaagacattattcagaaataagcctggttcatgcaacttatccacagagaccattttaattaactagtagaaggtgggaaatcaggtttccctttggttaccttttgcctaaaactgattcttcccaataatttgaagttgccctcacaaattggtttgttttaagctattctgaattatggccagtatgattggaatctaaccacctttgttttaaacacattgctgatatatttcctgccaaatctcttttctctattctaaagaactgattgccttttattgaaggcaagtcttattctcatggtgtctccagacctgaaacacagtaaagaaaaataattcaagtcaggatttaaatatgtgaaattccaagagtaccaactaggagactctttggaagatagaatataaaacaaacaaaacaaaaaaacagaaacatagattgttaatgctacttttttgagaccaatgtaactttcttttatttggcctctgtagagtacattttaaaaccatcaggcatgttgcagatgcaccctagacattttccaacaacacaggagtattgtgcaggatctgatcacagtaccagagactggagcacaccatttgctacctccctgggtgggctgaattcaactcaagcagttgaatggatgagataaacaaactgccattgcagtcggtttgaaagcagaggatgtacctgttctgacgtatacatccttttcaagcaaggaaataggaggccactctacagccatgtgagctgcacatcagtcagctgagaattctcaagtctgtccttagaaaaggaaagagaagacactggaaaagctgtactttttaaaccttcagaggactcaaatgctcttactgacatacgtcctccctcctccctccttctcaagaaatttgcaatgaaataagcacttttaaacacaaggagcaccaactaagtccagatgatgtatataggaaccatctattctgtgtaaatggtgtgtcaacgccagtccttagatcatctgctctgaaaatatgttctgtattaatttttcttctacatcttatgtattcttctccatcagagcacaaatatgcttactcacttcaaatattgattctaacaatttaactttaagaatggtttaattcacagatgtactttaattattatgagtcacatgttttcattgttctgctgttatcaaagaggtaaaaaaaaaaacaaagaaatttacctcttttgttcttttttgtgtgagaataattcaaagacagttcactcaggataaaaataaagttggggaaacacactcagattgttaatagcaactgagagtttccttcatactgttattttaaaagtaacttcaatataaagataatccagggaaaggttcctgggacttcattctctttcctataaaagactgttccaaaccttcatcttttgtaggttacttccaaaataatcatcctgaacaaaattctcttcgaaatgtggttaaataatgtttcaaagtctgatctaatttaaaactttatggtgttcattttttaaggaaggtgaagagtagaaatgtggtggttcatctaaactaccagacaccccagaacgtctggagtagcccaggtaacaggccacagtctaaagaaaaacctcaggaacaatggatctgagtgatattattaccccagaaggaaggagaaaatataggtggaattaggcaaagccttttctttcaggagatttggaataactttttaagagaggaagactcctggatgccaccctatagaaaggaagtattcaccttgaaaggttttccaagacccagcttggagtagaataaatctggcaacacacacacttctggggagaatctcagtacatctgggtgaagtttcatggccaaattattcctctgcgtctgcttgatcattgcttcaattgctttattaaatagctttgttggtacttaggagcaagactaaccaaccaaaatattgactagagattttattcttgcagttttagacacctatttatttacgtcttttctttaaactatatcaaatacgtaagtttgaaagttggggaggctctatcccatgtattcagatacatgtctataccttttatattcaggaacaatggcttaatttagaaagacagacttcccctcagagatgtaaaactgaaaagtatctgagacaggtcttactcaatttagaaagtttatttggcaaaggttatgaatgcatgacctagaggtaggtctgtgcctttctccagagatgattttgagggttttaatatttaaagggaaaagggtggatattggggaaagaagcaaatttttaaaggtgtgggtagttaagagacaaatggtggttacattcttttggtctttgacagcctttcaccaaatacaccatttacatgtgggaagggggtagaggaagagccacttaggccttcatgtagctcagttaatctttatttttacgacagaggacgcaatcagatatacatttgtctcaggtgagcagggggatgacttagagttctgtcctttgtcctgcacctgaaaaaataagttatcagtttacattgccagggtaaaattcaacagaaaggttttaggataaagatctgggacccacaaggaatttccctgtggtaaaattgtgagggacgtatgtggcttttgaaacatctttgtagctatattatttaggaataaaatgagaggcaggtttgcctgacatcattctcagcttgaatttccctttggcttagtgattttggagtccctaggtttacttgcctttcaaagacaaaataagttatttgacaatgatggaataatttcagctaaaaactgaatgtcagttacttggtggcaggaagaggaagaggaggaaatgaggagaaaatcagtcactggaaaagacaaactaacaggttaaaatagcagaacataatctggtgtcatatcttgggaagcagcaaaccacgctgggtttgcttcattccaatatgtgaatgtctctcagactagtgagaaaatcaacagttagtacacaatgtaaagtcaagttttattccctaaaacgaggaggtagaagaccccagattgcacaattaaccactatagccatcttgtcaaatcagtgttttctgtaactggcccaacacaaatccacctgcctaactctaaaatccttaaatggacttctacctctagcctcagaacactcaacttctaaaactgtaaagaagtaagagataataaagaaaaatgccatatttcctggaactctagagtagagtcttcaactctattagaattgttatttatgcttgaagttagtagttctctgtacatgcgtccttttgaatatttgagcctttgataccctattcaagtggattaagacatctacagcaacagaaatgtaatcttgattgcccttgaacacagtgtcattgagtgcaacagtttctcaccttgcacaggaacagtttctcatcgctgtgttcctacacagatgtggtctaaccttgacaacgacctcacctcatgccagccctctatatcttacaacaggccaacttcacaagaccatggaataacttacccagttcaaattctcatcagatagacacaggagtgattacataacatgcaaggccaggtgcaaaatgaaagtgcagggcccttgtttaaaaattattaataatctcaagatggcaacagaagaacattaaaccaagcaggaggctctttccaggatagggccttgtgcaacttcataggtcacatgcctaggaaaccagtcctggataggcattgctccaggagcctcactcctcaggagtgacatcattaatttattgcattgataaaaatatggtggcctatcaatatgatttgatcaccatttgaaaatgactgctctaaactttaagatttttgacttcagatcacctgaaaaaaagcaacatcctaaagattcaaggtgtcctccttttctacataatcacatttctttgtgccttcagtttgcactgttctccctgaaatgtctgtctttctttggtttcagattcacccaagaacctaacagaagcatttgtggtagtaaaggaaaaccaaccctctggaaaatacattttgagaatctcaaacatctcacatatatacaagccaaatggatttcttacttgcactttgactggctaccagataatcacagtgcgtttactgtgtgtaacgaaatatcctacagtgagaagacacagcgttttggcaacaccatggaaagtgggcttaaaaaagggttttctcagtgaaatttttgggcatcatgaagaacgatcaactatcttctaatttgaatctatagttactttgtaccatttgaaatatatgtatatatatatatataatattttgaaatattatctattctcttcaagaaatgaacagtaccacagtttgagacggctggtgtacccctttgagttttggatgttttgtctgttttgctttgttttgttagtcatttctttttctaacggcaaggaagatatgtgcccttttgagaattcaagatggcactgacacgggaaggccagctacaggtggactcctggaatttgaggcatcataatgatactgaatcaagaacttccttctgcttctaccagatggcccaaggaagcacatcgtcctgttttattgctttctaccctgtgcaatattagcatgcaagcttggcttacatagtcatactttatattcaattgatatataataaccgttctaacctcttccaggaaaatatttttagaactactagcttttccacttagaagaaaatgaggattcttaagggagccactccaccatgctattaagactctggcagagttatgggtaggatatggatccctacatgaataagtcctgtaaatacaatgtcttaaggctttgtatagctgtcctagactgcagaaatgtcctctgattaaatccaaagtctggcatcgttaactacatagtgctgtagcaacaagtcttatcatggcatctctttctatgtttggtttgctttttccaagagtattcaggtctcctcttgtgagataggaaggccatgaaaacaattagatttcaagatgatctatgtgaccaaatgttggacagccctattaaagtggtaaacaacttctttctaaaccta

SEQ ID NO: 221 - DNA, 20534 bp, Homo sapiens
tttaagattctggaggccaagaatttgactccccccggatccatggtctgtggataccaatgttccgactggagacggggagcccgcgagacccgggtctccagggtctgcccaaggaagttgctcatgggagcagacctctagagcaggatttgaggccaggccaaagaggttagttactgatgggggctgcataaattgggggttgtggagggacgccagctgggagggagagactggagaagggggtgtgtggagagcccaagaggaggcccagggggaggtgcgcaggcacagcctctgttgaaggagtctctctaaggctgctagggtccttcacctgtcattgtcaggcctggagagcgggcttttaaggaggccaggccacacctcaagggaagatggaggttaccggaaggtcatacctaaaattacgggcaaaaccagggagagttatgaacaggctgagttaggacttgtgtttacgttaatctgaggccttgcttggatttctttttaacctaaaccacaggcaaatattcccctttagggagagaattcgccgacatctatttaacatcccttaattgttgagagcatccactgtgtgccagacacttcggtacacacagaaagaaacccagaggagggtaagatgcccttatagggagatctttctcctcccttcctccatctctccctctctctctctctcgcttccctctctgaagacggtctagctttgggctaagtatacgtggcctcaggagtcaaatggatcaggacaactccgagctttgtcactgaccagctgggcacaggtgtgagtcatttttttttcttcaagcctcagtgtcccaatctgcaaagtgcatatgatggtaatatctacctcatagggtcaccctagggataaaatgagagaaggcccataaagaacttagtgtggtatctgggctcaataaggcatcagctatttttattagccattcaacaaacattttttcctaggatccaatctgtgccatgcagagtgctaggtgctgccagggagagataaatgagacaccctcaaggattcacagtctagtttgttcatttgttgattgatttcatcaataaatatgtatcatgccctacactgagcactggagatgtcaaagtattaataaaagacactgtccctgtccgcaggttgctcacagcctggtgggagagacattgcaacacaatgtgattggtgctgtgaagagagagagcacacggtactgggagagctcagggcagggggttgatccagttccgggcagggcgatggattcacaagacattttggcaaaggtagacccagcttccgtgtttcccagctcacaggtgcactcctaccctggggcctttgtacttgctcttccctctgcctggagctttcttcccctaggatgtccccatagcttgctccttcacggctttactcaagtgtcacctccccagcaagacctttcttggccaccctgtttaaagtggccactccagcccagtgtggtggctcatgcctgtaatcccagcactttgggaggccgacgtgggtggatcacttgaggccaggagatcgagaccaatctggccaacatggtgaagccctgtccctactaaaaatacaaaaattagccaggtatgatggtgcacagctgtagtcccacctactcaggaggctgaggcaggagaattgcttgaacccaggtggcggaggttgcagtgagctgagatcgcaccgctgcgctccagcctggggcaacagagcaagatgtctcaaaaataaataaataaagtggccactcccaccatcaacagtccccgtccccatccccaaacacacacactcagcactcccaccctgctccctgctttatttttctccatttcatcgatcaccacctgacaagctgtacattttacttattcgcttgtctatttctggcttctccctccagaatgcaagctctgccatgagggtagggttctcagctgttttgctctttgctgtatccccagtgtctagaacagtgcctggcacatgatacgtgcttgctaaatagttattgaatgataagtacgttaagtttacaaagatgagtaggagttgagtaagacaagaaagggagggaataacagatgaaaagggaacagggggagggagagagagacagagaaagagagagagagattgaaattagtgagtttaaggaactaaaagccttcacatccagcttattcccaggaatgcgttaggggtggtataaggcaaggctggcgtaggttgggggccaagctgtgcgaggccatgtcctgtgaggggagacaggtgcctctgacttgggcggatgtgctatgtgctgttacagaggttaggaagattgacccaggaaaaaaggaggaagccatgaactctgctggggagctatcagggaaggtgtctcaaaagaggaggcacctcctcttaggcccagggaaaaagtttcagtgttattctagacgtgacggacattctgaaggcctgttcccacatcccctgtcttaacagacagacactgggttagaaacttttcggtgcttgcacgggtggatttcactttgcatttggtcctcgtagtgcctaacgggacctctgcccacaaaattgctcaagaaagatttgctgggttggattgggattgaggcaggtggagcggccttgaattgtagatgattcaggctcatgagcctagaaccttgggcaccatctgtgatcttgccaggcagagtgacagcctttcctagggtttctccctcctcaaaaaaagaagggacattaaccatgtggaaaaacaagtagattttaaccagttagaaaaagagagtggagagcattttaggtggaggaaaaacaacagaaacaaagacagaaaggaaggttagttcatgggagatttcttaagagtgaacagtttaatggattacatttttcaaagataaaacatgtatttgctatgaagttggtgtgtggattgccttcttagccaaagttatggtgaaagttgaacttgagcctgttattaaccaatagctgtaacatatgtataagctgcatgtgcatgctaggctgacacccagatagaactagtggtgtgtatctttacaggaagctgccaatttacagcctggctgaaacccacttggggctgcttctacttccacatttaattggttcatccatcccatcattcttttattccacaaataattatcagccaccagatatgcattaggggccgggtgcggtggctgacacctgtgaccccagcattttgggaggcagaggcaggcagatcatttgaggttgggagttcgagaccagcctggccaacatggtgaaaccccgtctctatgaaaaatacaaaaattagcccagcgtggtaatcccagctactcaagaggctgaggcaggagaatcacttgaacctgagaggcggaggttgcagtgagccgagatcacaccattgcactccagcctgggcgacagagggagactccatccaaaaaaaaaagaagatatgcattaggccctctgctacctgctaataatataacaaagaacaagatgaacatgtttcccgccctcagatgcctatattctaggggcaggcataaggcacatgagccataaacaagtaagtaaaagagagttaaagatgacggtcagtgccatgaaggggaaaaacagggtgaccttgggtaggtagtcaggggaggcctcctggagaaggtggcatttaaggcgagacctggaggataaagaatcaaggactaagtattctaggcagggggagcaggaaatgcaaaagctgttgttggaaaagctcagagagttcaagaataagtcaattcgagagcacagaatgtcagagcctgcgggcatcctggagcccatccacttctctcatgctggtcattgctcttgtaacatatctgcacacgactctggcctgcataaactgttgcagggagggggtcctacagggcagggagcacaaaataattgacagctctctccatgttacggagcaactgaagggcttatgagttttctttgtttttgaaccttggcaaaatgtaattttaaaaacattttttacaggatagaaccgaggcttcataactgacgaagctgacttcatgagctttgacagatcttgtctgcattttaagtgtttccaacacttaaagattaagttccttttcctgagaagtcgagcgggggcatatcccacccactcagtgcccacctcccatgcgacatttcttttcctaaaaagtggcaaataaaaagtgccttccggggagaggaaactcaccactcccaagacagctcattcaattcccaggacacatgagctgttagaaaaacgttcttggattgagccaaaatctgactgcttagcgcgtccgtgcctggtgggtgttggttccgcaatctggagccacatgggacagttctgattcctcctactccccacagcccttcagagatttggagacagactgggtacccccagccactttccaaacccaagtcagccccaattccctcccttctgtctcctgtgatccagacacctcctaagcctcctcacatgggggcccagggccaggcacatccctctgggtgtggcctgctaggaaccctcgttctgggcaccacagtcctgccaccaccgccaaagatgaccactgcctctgtgatgtgactagtactgggtttgggggtcacgcatgtgattgctgagctgtgttacccaccctgtccttgtgcagttcagctttgggggtctttggacagggcctattcactctcttcttatagaactcaggttatcttgttcttgatcaagatcaggataagatcaggacaagatcaagatccaacctccttagcctgacccccaagggcctttgtgacctacccagctccatctctttggccagtccttcccaccattcctgaattcctactaaacacttgaagaaagtttctgagcagtcacttgggggcatgtcccaccatcctgttaaaaataaccagtatttattgagaccttactatgtgcctaaacatctaccgtgtatcaactcagaacatagacatgagacaggtacaattatttacccaattattcatgatggtgaactaaggcacagagcagttaagaaagttgccagaggtcacacagctaataagtggtcgttccagggcatgggcaccatgcatccagcctcagtccatggtgtgcagcttgtattggcttatgagggctgaccagtgattcctccaggcagagagcaattgtgaggcagattagacttaagactgtaaggagtggttaaggactagggcagagcaaaacacataccacatctatgggggcagctacttcttggcaatggccagttgttgcctgtaggagtccagacccaggattcctagatcttttaaaaagaaactggaaatggaaatgtggaaatgtggatttctttctctttttttttttttttttttttgagacaaagtctcactctgtcccccaggatggtgtgcagtggcgcaacctcggctcactgcaacccccgccttccgggttcaagcgattctcctgcctcagcctcccaagtagctaggattacaggcactcgccaccacacccagctaatttttgtactttttagtagagacagggtttcacctcactggccaggctggtctcgaactcctgacctcaattcgggcctgcctcgggctcccaaagtgctggtattacaggcatgagccactgtgcctggcctggaaatgtggatgtctgtctaggatctcttagcatttatacattggcagctaattccattttgttttttttaaagcaccgtgtagatcaagcaaagcatttcttagggctgtatggagccctgggctgaaagtttataaccaaaaatccagttccactcatcggcaattattggaacactgaaccaacttaaccaactgtaactcagctctcacttttccaccttgtttataaggaaaccacgtgacactctggttagatgtcttgtgaaaatcccaatcattatgtccttactgggtctcaacccttttttgtaaagaacacagatttgacagacagatgggtcaggtgtacgattctgggtcctccttttactaactgtgtgaccttggatgaggtacctaacatctgcccctctgtttccttgcttacacgttgggatcataatgccccatgagattttgtgaagattaaggaataccatgaatgctgaacttgccttgcacttgtagcatagcaaatgttcattaaagaccgagttcttccctcattcctttctgagccatcagccttgtaatcccctccaacaggaaatgccagagtggacagcatatcagatgagttctataacattccagagacaggtaagctccctgtggaaagaaggatcatggaagacttcccggaggaggaggacttgatgtagattttctgccaatgagctctgggtaatcctgttgcatgtgccaataaaccatttgacaaggccagggatatctcagcagcttaggttctcagggtgagggagtttccaggtttccatggctacccttggcagggctttagccctggggcgagcctgcatgtgatagacccagcaaatgacagagaacaagtgtgtttatgtgatgtttaattagttctacaaatagttcttgaggatctataatgggtcagacattgttccaggtgctaagatcagaaatggatcagaggacaattttgccctcaagaggcttccattcaattggaggtggaagtggctggggcatctttaatcaccgaagtgtgaatgattggatccattgccaagaaaggggaactgggaaagactgttttgaggggacagtgagtttagttctgaggttcccaagggttattgggatagaatatcagactctatctatcatctgtctatctatccatccatccatctctgtgtaatcatatttgacgtgtggactgggcagtggggtgagaatggagctggagccagaggagtcgtgcattcactcagcaaactcttactgagcacctactatgtgccaagtgttgggttacagaggcgaagcagacgcagagcctaccctcatggagttctcagtttactggaaagacataatcacaatatttatggtagttatgacttactgagcacctacagggtgccaggcactgtcccgggccgttctgcctgacttatctcatcgaattatcagcgttactaagtgagtctggttctatgattatcctattttacacagataaaactgagacccaaagaggagaaaaagctggttcaggtgacacagtggtcacagctgagacacagatttgaacacacgtctctcctacgttggatcttggatctgacattgtgctttctcctggttgctgtattcagtcattccttcattaagcattgtttgttgagtcaaagctagggccaaacttctctgtccgggacacccccggatgcctgcatagaaataagagctaaatccctgaactcgaatgagctcatccagagagtggctgagacagagaagggcaactccagagggcaggtcccacaaacacacctgcatttggggggccagcagagatgggatggggggattagccacaggagggcaggcggcacagtgcagccttgtgaagcccagagggagagagagtttcgagaaggaggaggtggacttcaagatgagtgccctgaaggactgaggaggtgacccccaagcttgggctatgccaggctttgggggtccctgagggcaagctcaaggatgcagcagatgccaggcagtgaagggttcagagtgggggatgacgaagggcagccttctctgtttagaaatttgacttttagagaaaaaaagaagtagaattgtccctagaggcaagggatttttttttcttttttgtggcttggttttgtttggttgagaatggcggagcaggtgtgtgttcgtaggtgggggaagaaactggttgagaagaagaaacgaaaatacaggatggggagaggactcttccccatggctctgatcaccgccagacaccatctgtgtttacttctgtcttcacgatctgtttcccaccagccacaagggcagctctgtgaaggcacaagttctgtctcattcaccgtgggatcccagtgcctggcacgtagtagacacttcataaatatttttgatattgagttgaattcacagggttcttccgggagcccagtggttagtcctaggaagagaagggttcatgggggccttaaggaggggcttctctctgatgctaccatgacaagagagagggagagaaaaagaagtcaacacaagtagaggcaggagccaaaaatccaagtctttggcggggtacagtggctcatgcctgtcatcccagcactttgggaggcacgggtgagaggatcacttgaccccaggaattcgagactagcctgggcaacatggtgggaccccgactctataaaaaatgcacaaagaaattagccaggcatggtggtgcccactgtagtctcagctactcgagaggcagaggcaggagggaagatggcttgagcccaggaggtggaggctgcagtgagatgtgattgtgtctctgcactccagcctgggggacagagacagaccctgtctcaaaaaaaaaaaaaaaaaaaaaatccaagtcttctcaaaaaagtgtgtgtggggtggtggtgtgaagggtggaattaacagaagtagaaaatggagaatactagtagctacttatgtcctgtgagaacattctagaaggtgagctgtcattgatttattagcattactctgcctttgctatggctctaagttataaatttaagaattcatttaatcctaacaacagctctctgaggcaaatgagcttcagtcagccctgaggtgatgtggctagtggtgaggaagccaggatttgaacccaggacttggagctgatatagagcctgtgatgttacccactgggccatatacttccccaactgacattagtttatatgccttatttttatttttatgtattcatttattcattaatagagacaggggcttgctttgttgctcaggctagagtgcagtggtgcaatcacagttcactgtaacctggacctcctgggctcgggccatcctcccacctgagcctcccagggtgagccattgtgcctgacccacatgtgccttgttttatatactacattcctcaccaggagcctctgggtttggaggggctcataattctcatgttttacattaagaacagagaaatatagtgacttgcccagggtcacacagatactaagtggctgagctgggactccagcttgcatctctctaaccgcaagcctggcactttccccttccctgagagaagaactgtaggaagttagcacagagtcaggtgccaaaaaagggctaccacctggacgtggcaggcaacattctgtggtgtttctgcaggcatctcccgagtcaccccagctcaggaacaaggcagaaaaagttgggggttggcaagttaggaacaagaggaagaggacggggacaaagctgcaagtccgggagcggggctgcctgtcttctctggcagttcctgggttgaggctgagcaaaacaggataaaatctgagcaggagcccacggctgggggacttggcaaagacccagtgtggtgggtgggagggaggctgtgccctggagggggattccagggttcctgttcttagtggggaagagccctggatcgagggtggcccaagctcaactctgatcactgtccctcctgatagccacctgggcactgtgacctgcttcagaaaacagctgcttctgtggcagtaatcccagcactttgggagtgtgaggtgggtggatcacttgaggtcaggagttcgagaccagcctgaccaacatagtaaaaccccgtctctactaaaaatacaaaaattagccaggcgtagtggcatgcacctgtaatcctagatacttaggaggttgaggcaggacaattgtttgaaccagggaggcagaggctgcagtgatctgagatagggctactgtcctccagtctgagggaaagccagacttcgtctcaaaaaaacaaccaaaataaacaactgcttctgaatacacaatggaaaaaaatccccaggggttgtgccagggtgaggggaagtagggcttcctgtgtgacttaccaggaatcttggagctggcccatgcaggggtgtgggaggtgacagagaggtctttaaaaccaggtgggcccagccccggcctcttctgtgggcctgaggacggagaaaaggtctcactggtgaggaatctcatctttggggctgctttgcctgagggaggtgcagagagcagggccgagagaggggctatgagaggagacacctggcccccttggtcaggggagcagggcccgaagaggagtgaacccccatcacctctctcacagacagcaggagggctcagcagtgccttccgtgcaatgaggctccgcactgtgcgttctttccagccaggagacctgaactgggaggtcttggagctgctgcatgtggacttgggggacccgtcccttggcaacctggccacgtcctggcctccacatcttcctatgggctgtccgtctctattctctcccctctcattactgcaaccgctgccctcctctgaaattctctcgcggctatgcgcttcctctctgtggtcgtttgattaaaatagctgagtccacatcctcctcctggcgcccgctttgggctctgctgagtggatggctctccactcttcggggcagccactccatgcctctgccacctccaccatgaaactgcttttttactctttccagggtgtgggttttctccaggtatggggaggccaacagatcaagaaatgattgccattgaaaagatagcttgttatttacagctcccagaagaaggcgtgcttccacccagggccacgcaggaagtgccaggtcggcaggtcaggaggagccacgggaagcatcgcccagggcctttgctgtgatctctgggaaaggctggtggggcaggggacacagtttaggaccggtcagtttgaatcatgtcagtggaactccaggcttccctagttgtccagtttctggccctggggtgatttagggcaggagaaaccttggcttggagtgtgagagtgagggaaaggtggcccgggtgtaccaaggcactggttgtgtcagcagtgggacgtatccatacaggcctcagcatcctcaggtcttgcctcctcagaagaaagaattctcatggctgtaatcccagcactttaggaggccgaggtgggcggatcctgaggtcaggagattgagaccatcctggctaacatggtgaaacccatctctactgaaaatacaaaaaattagccaggcgtggtggcaggcacctgtaatctcagctacttgggaggctgaggcaggagaatcacttgaacctgggaggtggaggttgcagtgagccgagatggtgccactgcactccagcctggtgacagagtgagacaaaaaaaagaattcgactgagggacataaggcagaaggagagactgaggcaagtttcacagcagaagtgaaagcttattaaaaagctttagagcagggatgaaaagaagtaaagtacacttggaagaggggccaaccaggcgacttgagagattcaggggttctgtttgacctttgacttggggttttatacatggcatacttcaggggtcttgttttccttatcccctgattcctcccttgggttggtggggtgggctgtccgcacgctcagtgacctgccagcacttgggagggagcatgcacagtgtgttgactgtagttgtacgcatgctcccttgaggcgttcttcccttaccagccgaacgtccctagcaggtcatataccagttaaatgccgccattttgcctcttcatgcacatgtgtgagcccactcacccagctcctgagatcttactggaagctgctgatcacctgcttcaggtattcctgtttattgggagactacctttccctggtgctggctgtgaccagttattattttagagagatggttaataatttcctgcccatcacctgatggttgcctgacattcctgccctgctcctgtctgaccagctacctactgtcacagttggtctgtatatgaaaggcatgctcacagaggagccatctgaggtgtctaggaattaactagcagccctggaaggagcaggctgtctctggcctccaagatgtcaaagcgtcctaaaatatagaaaatcaaaagcatgtttagtgcccagggatgctcagaggcagtggagtagagtcagtcaaggaaatagattcacagttatgggctaaacccttggggacctcacttcaattgtctgagcctcaatttccttatctgtaaaatcaacaactgttattcattgaacaagtgactgtttaaaaggacagacaccgggcctgccaaggtcattgatgggtttagagagatagaggatagtgcttggcacaccagaggtgctcagtgagtggcaggtggtgtccttgtgccacagctccagggagcagcagagaaagattggtgtggaatggtggggtctagggccatttctttggctgtttggagcccttggagcagaggctatgggtggacagaaccctcaggaatgttcttgggattcagagttgctgctggacaagggttgtcccagaggccagctgtggacagaaccttcaggaatgttcttggaattcagagttgctactggacaagggctggcctgccagcccagtagccaggagcccaggggagtctgaagcatgtttggaggccaggtcttgggaggcgccaggggttcaggtagagctctggcacaagcgaccgttcaactcagggacttgagacaacagagcactgaaggggagagccccaggcctgccgagctgtggacaaacaaggactttggatcctaggaggaaggcaatcaggcagctgccggcaaggaacctctgagaagccaaattagaatcaggtgctggcctgagacacatggaatttcctggactctaagctggcaatggctgtttttaccaaagacagattctaaggagtgaagccaagggctctggcctgagaggtagagcatgagaaggaacaaacacagacccctaaaggattcatgcctctgggaagggaggctgcgtggtgcagtgaggggtgcagaaggacgcggctcgaatccagcctccactgcttaatggctgtgtgacctctggcaaggtccctgagctttctgagcctcaactttcccagtggcaaaatgagaacagtaatacctaccctgcagcactctcgtgagcccccagggttgacttattctttaggtagacacagtgcctgggtcccaggagagtgtcttaattttataaattcttttaaaatcaagaggaaggaaatgaacataataatgaatatataataataaatccagcttggattacatttttctttatagcatcatagttgtcaaaaataattatgtgaatatagatataaagatatagcagaaagatgcctacaaaggcaaaagcgcttggggcccataagagccataatcaggccctgaaagccactggcacattgtgggagcccaggcttcactgctgagcacctcctctgggccaggcactattctcagtggtagaatagaggtgtgcatccgcccagcctctgcctgcaaagaaccatcagggtagacatccttaaaaacaggcaactacagcactgtgagctaaaaggagtatgagatgtagaatcaccggctttccttctgccctcctgctgtgggcgtcaagtgctctctgtccaggaatttttttcttccgtcttacatctttcatcaaaggccatgtctaggttatatcaagtcctgcttctccacgtatgccaccaaatctccatttaagaatcctgcccattctctggtcccttttagccattttgccaacggggtgagtatgtctggggtgtttgtggctaaaagtgcactggtggtagggacagtgtccctgcaaatgcttccattattgtccctctgcctccagggccctcagtggacctacagttttttgcctcatcttttctggctggactcatcttgtttattgcccaccatgacggggagtggaatagatggggcctggtggagagccagggtgggatctgaatgggccacgggggcattgcctgatagatctgttgtgggatgtgtttttttttccagaaccccagagatgaaaggcctcctcccactggcttggttcctggcttgtagtaagtgctggccccgtgaccttcgaatgaacttttaccccatgggagtaacagggtggtgaaaaggacaccagccattgaggtcgtagagacttgggtttgaatctcggctctgcactgactgcatagacattcagcaagagccttcatgcctccgagcctctgcttcctcatctggcatgggctaatgcagtccatgcgtaaggctgtggcagggtcctaggagatattgtacctcagctgtgtaaaggttgtggacatagaggttatgtggctggcaagtgtaggaggcagattttttccctgtatgcaaataaaataagatttacaaaatcccccaatcaatccaaataaaaatcaaaactcttatctaaatatcccaacctatgattcctgggtcattctcagctcaggcttgtccagctgggaagtgactgtatagatggctttagtcccatcctgcggccccgtgaccgtatatacaacccccgacaggctgtcctgctccttgatgtcttgctagatccctggagactccaggaggagctggaggcctggtgcaaggagagagccttgggctcactgtgaaaccctggacagggcacctcttccctccatgcctcagtttcccattagtaagatgagggaactggcttcagcgatttctaagagtcccatcctgcttttagattctctgccttatgttctaaagggtgtgaggggagggagtggtggggaagagggatgtattgccaagagagacaggaagctcctatctgcctgcttcatgcaaatacattatgaattacaccttatatgtcatggtcacttactatgtgtctgccaccgtgctcaaaatttacatagttgatcttattttaaccctcatgacaactccaagatgtagctgctaatttggggtccccgttttccaggggatgaaactgaggctctgactccattcaataccatactttgaattagtggcagagccaggatttgaacccaggtctgctcatttttcaattccaaactcttaaccagttctccatactgcttgcacctcccttcccactaatggagagaataaaaaagagacatgcaggtccctccaagccctgggtgggagaaagggtaggagatgttgggcagtgggcctaaagcagggctgggctgcctgggtgtcacctggggacatgggctatcttccaggtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattggtgagctgatcgctataactgccctttaggctccaggctctgcacccatgttttcttattcaattccatatcagttctggaagatgagtattaaagtaccattttacaaataagaaaactaagcctcaaagaaattagctggcaatcccaagatctcagtggcctaaggtgtcagttggtcaactgtggcgtaacaagtggtcctcaatgtagtagcttatacagcactggtcatttactttgcttatgaatctgccatttgggtagggcttgtggggatggcttgtcgcagcttcagcttggacaactgaggctggacaatccaccttccagatggctcactcctatggctggcaagtggtcagcatctcctggcctaggagcgggtcagaggcctcaattcctgtcacttaggcctctccaaggatgttcgggattcctcccagcatggtgactcttgggttgcaagagtgagtgaccccaaactgcaagaccaaaggatatggtgttttatggtcagcctcagaaatcccattgtgtcacttacactgtactcttggtcaaagcagtcacaaaggctttaagagggagggcatctagattccacctcttgatcgggaagtgctaaagttctagaagaacatgtgaaatgggagattttgctccttggaaagcatacccaactgggttaacaattctgatactgctagacatatataaaggaaagggatgattaagcaaatgaaggacagatggttggggccaagtttctcactgttggagtgggataagccagggcaggaagccagaatgatccatgtgcaaaaggactaaagttggagacatcagtatggactcctgtttagcttattgtagatacagatgtttacatgtggaagtatgcataggtagcagtatgcatagatatcatggatatattagtatcatactaatataagatgtaagtaataggagaaaatggtgtttcctctgtaagatcttctcagtttttctgtaaaccaagaatactttttatgtgcaatctgctacacctaacatacagtcatccctcggactggttccaggacccctgtgaataccaaaatctgcagatgctctagtccctgatataaaatggcacagtattttcatataacctgtgtgatcatatactttttttttttgagacggagtcttgctctgtcgcccaggctggagtgcagtggcgcaatctcggctcactgcaagctccgcctcctgggttcatgccgttctcctgcctcagtctcccaagtagcatatacgttttttttttatacacatgggcaaatagaaacattcttttgctatcagtggagagggtctaaaagaaatgacatctcagtagcaacaagcacacttaatgcctagatctagtttccaatgtcattcttcaatagaaggccccttccaagtcatatatatatatacagggttccttgaagaaatggtcaattctaggaccaaggcaggaaatatacgagatgagcctggaacttcttttagtgccaaaaagtaaggaagtgcttaaataaacgcaaacaaaacggaagcccacattgatggggatgtgacaagtggcacctgtgctgactgaaagagcccccagtggccaaccctggaacaatttagcaacaaaataaatggccccaaactccagtcttatcatgagaaaaaagaaaatcagacaaatcccaatcgtggggcatcttataaaatgtctaaccagtaccccctcaaaacagtcaagaacaaggaaagcatgaggaactgccacacccaagaggagcctaaagagacaagaccatgggccgggcgcggtggctcacgcctgtaatcccagcactttgggaggccaagacaggtggatgacctgaggtcgggagtttgagaccagcctgaccaatgtggaaaaaccccatctctactaaaaatacaaaattatctgggcatggtggcacatgcctgtaatcccagctactcaggaggctgaggcaggagaatcacttgaacctgggaggcagaggttttggtggtgagctgagatcgcgccattgcactccagcctgggcgatgagagtgaaactccgtttcaaaaaaaaaaaaaggcaagacaatgaaatgtaacatgggatccccagtgggatcctgggacagaaaaaggacattaggtaaaaactagggaactctgaatcaattatggcttttttttttttacaattagtgagataatgatgtattatttagtgaataattatcaataatgtatcaatattggttcattaattctaacatgggtctcatactaatataagatattagtaataggaggaactgggtgtttcctctgtaagatctcaattattctgtaaaccaagaaaaccttttatatgcaatctgctacacctaacatacagtcatcccttggactggttccaggatccccgtggacaccaaaatctgcagatgccctagtccctgatataaaatggcatagtatttgcatataacctatgtgattgtatccccccaaccatttttttttttctttgagacagggtctcactctggttgcccaggctggagtgcaatggtgcgatctcagctcactgcatcctagaccttctgcactcaggtgattctcccacctcagcctcctgagtagctgggactgcaggcacgtgccaccatgcctggctaattatatatacatttttaaatagagacagggtttcaccatgttgcccaggctggtctcaaactcctggacttgagcagtctgccttggcctcccaaactgctgagattataggcatgagccaccgcgcccagctgcgatcacatactttaaatcatttctaaattatttatcgtagctgatgcaacgtcagtgctatggaagttgttgttgtattgtttgggaataatgacaagaaaaaagactgtacatgtttagtatagacacaagaaaataggcctgcttacattttccatccatattggttgatccacagatgtgggacctgtgatacgagaagtttatttctggatcacataacagttcagtaggaatcacacgttggctcctcccatcttgtagttctgccatcccctatggcctcagaattctttgctgggtcatctccatccagccgaaggatggcggcagaaggacagtggagtaaactgtgggaagtttgtctgggcaggtctggaggtggagtgtattaattccacctacctcccctggccaggaccaaatcatgtggccacacctactcgcaagggaggctgggaaatgtagtctagtcgtgagaccaggaggaaaaagagggtccatgacctgctggctagaaatgaggagcaggaaattactcagtcacactaccagatcctccctgccacatcgcgtccaccaaggtggcctctgctaaagtgacatggttgaatttttgctcctattagggatggggtcaggagggcacccctcccactcgggatctaagtctcttgcacggacaggtgctgttgggcgcatgaccactgctatgggcggctggaggagaagggctgcaacattcgcacacagtcctacaaatacagattcgcgtggggcgtggtcacctgcggtaaggctggggcttcccgttcgggccattggaagagcacctgactttaagttcagctgccctagagaacagccagcctgtatcttgttgggggaggaggagttgggtgcagaactgggacgagaggagcaggattattgcagctgtatcagacccccagggtagggctgaatcatccactgggtgcaaaagtgcttgacatgcttcctttttcttgattcccccacaaaatacctgtagagtatgtttaggcttctccattttagacatcaagaaatggaagctagaaagcctgccagtgcacacagcaggattcaagctcagggcctctgagttcaaggctaaatctggggatggttctgctctatgagaatgagagttcctccagagcagcggctgcctccaccatcagactgggagtcccccagaggaaggaaggtgcttcctctatcagactgggaactccctgagggcaggagctgtctcctgcactgaaacctcaccctgagcagcagctgtgccccttccatcagattctctattcccccgatttaggagccatgcctcttccatcaggctgaaagctcctcggagcaggaagtccatggggtctctgctgagactggagcatgctcttcccaccctcattctgctcttggtgtccttttgcagagcccgggcccttctgccatgtgaacctctgtgcctgtgaccggaagctcgtctactgcctcaagagaaacctacggagctacaacccacagtaccaatactttcccaacatcctctgctcctaggcctccccagcgagctcctcccagaccaagacttttgttctgtttttctacaacacagagtactgactctgcctggttcctgagagaggctcctaagtcacagacctcagtctttctcgaagcttggcggaccccc

SEQ ID NO: 222 - DNA, 173594 bp, Homo sapiens
gcttcataaaaagagggacaagtggctggtgctgtggacagagaagctttatttttagtatgagacaacctctattttctttcaggagagggaagttggattatcaattcttttgtaaatgtgtatggtgatatttgctccggtaagtttacagctatcttgatttacagctggctgtggggatatgtgtgtgcatgtatgtgtctccataggcacatttggattgtacacttttctttccaagtatcagtttttaagtctctagtaataatctctatttttcttgactttgctttcttgtaatttgtatgtttaaaccaaagaggctgtgttgatactgaaatgcttactttagctgtttaagtatgtgctgggtttctttgaacatagtaaggaaactatttaagcaaacttatatttgctttataaaactgtaatgtcattctaccctacccctccttccttggagtgtttaatatcctaaatacattcattgtgctgcaacctgcttaccattttaattaaagtttcttcatcagtgtcagagtgaaaattacttaaactccatatacagctaccaaatattatatgttgtgctgaaaggtgctagttttataaggtcttatagcagtatgtagaaagaatgagtttcccctacgattggatgcatgcacctttaaaaggactgaatttagaaaaagtattcagatcactaaatgaagtcctagcatgccatgaaaagctacaatcacaagtggctgttgcttctctttcgtctttctttgcactgtgtatttctgccaccatctgtcagatgcccagtccgggctcctgtgtttctatatgtgaagctaatcaggagaaaagttgctgttattaaatttaactactgcaaaatgactgtccggtcaccgttgctggaaatgatttttaaatgcattacctggttagctgcgttctttttgttcgagagtaaaagatgctctgaattcttcattgttaattcagaagtctggggaaaagtattttaatataattattctagacagggatgagaagatgattaaataattgctttaatggaaacaaactgatgctttaatcttctctttttgttatacaatcaacaaatctgcatagtctttttcatggtgaaacgagctggagaatagatttgtgatgaaagttaaaggcaccatggcatgtgaagcaagacgaggtctgactatacatttttcagagatttcgagagtaaagttgggaatatcatgcaggcctagggctcgtaggcatagatttttttcaggatagcaatttttcagattttgaagtagtcttatgacagctcagaatgcctgtctgggagtgcactaaccttcatatctactcccttttggacgtgccacgactcacacacgctgtgcacactccaatgaagctactcattttgacaaacagactgaattttgatcaatctaactcagcctcaaaaatacactaatcccccaaacccacccaagttattatattgccttgttactggtcccaataagcatgtgcctagtgtcagtcttagacgacaaaccttagctggagccaagtgtatcttagcagataatttgttggaaaaaaaacaaaacaaaacacaaacaaaacttttatccttgggctgttgccaattactgctaagtaaactcaccagcatggaacatcacctcttcccctccccaacacacacacatccaatccctcaacgtcctttaatattttatataatatattttatataatcattctcctttcatggctgtaacaggttgtatgtgaagtcatttgctatagacagagcttatcatcatctgaagctattcagtaatataaattaatgaaacttgaggtggcagcatgcattctgcatgtgaaagttatgccttttcctccagtctgttagtttacagaagtgttagggctccaagcatactcaggcccacaaaggaagaacaaaaaggcatctgtatctttaaaaggtcgggatccttagttggagttagagccaatgtgcacagtttttacaagtatcacttctgaaaggtccataatatcataaccagaaaatctgtcataatctcttccaagcattaaagacttttgtcatttgggggaaaacaataaagggatttttaaaatttcataatcagctcctctcttctttttagcataatgaagaatgcaagagtcatttccatttagtaagtacatcctatatgcctggcactgtgctaagcattttacatggcttatcccctttaatcttgacaagcactctatgagggccataacattacctctccattttacagatgagaaaatggagacataggacaagtatgtaacttacttgaggaaacacagtgagcgggatgagtctcggaaccaggcaggctcattccagagtcctgctcttcctacctcccatctgtcattggtacaatctacaacaaacgcctagactgaaatgatttccagggacctatagttaaacatcctatttttccccattctgatacaaggtagtctccttcctctcagactatgtctttatgattccaagctaagtatgtctttgaaactgaagaatatgtgttttatttccactcaacttgagcagatacaaagatatgagtgtgactaaatgagcccacctagggtaaaatttatgcagaagtggataaatcaaggtagtagttcttttaattgatcaaagtaaatcaattcctttgaccttcagtcttttggacatagtcaaaataaagatgcgatgacagcttagaaatatcaatatctcaaggcagctggttcgtcattggtgcaaaatataaaaagcaattccaacggaatcatttttggagagctttacaaaattctcaccttccctttactcactcccaccatgttttttttttttttttaatttctattctttggctagctggaaagggctgaggtagcacttcaggttgaatattgcaaagtgtctatctcacctgggtaatttaaaaaggaacacagctgtcaataagcatgctgagaagcgtgacaaagacgaaattcagagtccccaaatgcattcctttgcacctgagcagtgggctccccattttaaatccacttgagccaataaaattcagatggattttatagggggaaaatgcaactgacatagaatcaataaggttgaaatttctcttcaagtggcagcttctggatgagaagcagggcattctagtcataaagtgagcctgtaaaatgctgcattatgagaaaggattatgagtggtgaaaatgttgctagaagatagaacctagctcacaacacctttgctaaatttacccaaactcagagggatcttaaaaacaaacaaacaaaccgctaacaagcaaacaaaaaccacccaccacaaattggaagaactaagagtcaagttttgaagtggttaacacaatattgagttcttggtgtgatctgctgtgtctaataagcaacagcttttgagctactcttggttaggcacccagttagttaaaaaaagttcagagtgcagtacacaataaaatacatttccaaaatgatagtcatttttgtcagaggcaagcttggttaactcctcaattctgggttatgtctttctcttgttcttaaaaaaaaagtcataattgggtggtttaatcagaaagtgtggtattagagccaatactgataaataaattcaaatcaatttgctttttccaacagcatttatgagagttctaaatatactaacggccatcaaacgaaaacttttactttaataaaatatattgtgctcaaccacagtgttcatcaaatatagactatccctaaaaactaatcttataggcaagtttataaagtatatcatatttcagtccctagctagaagatgctgctttcttcagaggggtgactaaattccaaatcaatagtactgaggattgtactccatcttgcctatgtttcaacctgccctttctttggctacagatgtgtgtacttaaacatattgatcattaagcacttaaaaattatctattaagtatggagaaagcagctggtgttaacacataattagttttggactaatcttgcatttttcgttaaacattctaggctggtgtacaaatagagctggtggtcctgttacatgcttgtgtaagaaaataagtcagtgaatattttgagcctgaaatcagcacatgaagcactaaatcttctagaagaggctcttggtcatcagtgtgtctttaaatgtttaaagattcagggtttgaaaatggaaacacctcagtctctccactctgcagactaatggatctgcataattaatatattttactgtgatttttttttttttaacacaaattctagccaaaagtactattggaaaattgttcaggggcaactccaaacatgttttcttatagtttctagaaagcttactcacaacacaggctatcagtttaccatggagctttgagttggccaatctaagtggatgatcatgacattattttcttttggagtaaatgatgtgttgggcataaaaggtttctactggtattccccaggggacttatttagccttgcctacagaatatttatttatttatttatttttgagatggagtctcattctgcctcccaggctggagtgcagtggtgcaatctcagcccactgcaacctcagcctcccgggttcaagtgattgtcctgcctcagcctcctgagtagctaggactacaggcatgtgccaccatgctcagctaatttgtgtattattagtagaagtggggtttcaccatgttggccaggctggtcttgaattgataacctcaggtgatcctcctgcctcggtctcccaaagtgctgggattacaggcctgagccatcattcccaaccttacacaatctttaaatcctcccaaattaccacaccttgtctcaatgtagacttactggcaaagatataacaaatattttgggctcattttatttctggtaaaatatggctttcagaatatatgtgtcaaatatgaattattattgcaaggacttcttaagtcaccatattgacattcacttctcaatgttgaacccacacatctttatctggctttagatctccatgagggaggaaaatggataagattttccaaaacctgtgacattcaaactaccttcatatgaaattgaatggcagaggaaaaacatttttttttaattgggggaagattttagaaaaagtctggaatgtggatgtcactttttttttatttaataaatatttaaggatgcctaccatgtgccaggcaccatgctaggcatgggagatacaatgatgaacaaatatatataatttctgcattcccagaactaaatgccttcatttttccattttctcacctaaactgagtttctatttcatggcccaggatgtgttttcttaaaagcataattgaactgttctagtaaggcatttgcaggaaatgtgtgcttttggtcctatatgttcacactcagtgaaggaacaagagtgaatccacttatttactgatgtgattattgtctgctgaaatggagtggtaggaagcagggagctggaaaagattttgtagtgtgtgtgtcttataagcattatttattgcttcgaggcattctcagatttgataggccattctcattcttggacagtattgggagaggaaagaagggaaaaaagctttgaaaggaaagaaaagtaaagaagataaagaataaacagagaaggtgcctaaagaaactatgattttccctggcaatctgaaatagatctaacttgtattatctggttttttgtgggtattcactcactcatctatctattcaataaatttatatattgggtaccctctttaagccaagtacactactagatgctagggcacagaaataaacaagatacactagttcctgaattcatggaacttctaatagaccaggatttctcaaacttggtactattaacattctggtgcagataattcattattgttagggggctgttttatgtattataagatgttaagcagcatccctgccttctacccactatgtgtcagtagcaatctccccacccaacccccaggttgtgacaaccaaaattaccaccagacattgccaaattgcccctggctgagaacagtacaggaaacgcagtaattgccaccacctttgaccaaatcctcccaccatatttctacttttctttctttcagatactctgctgcacagtttaccctagggtttttaagttgctttccccgaatatactagtgccatttgccaacaaagacaagtaaggcatctctaagtccttttactattactatcccttacctttgcataacactttaccacatttgtgtagcttacattatctcatttgattctagcagtcaactagtaagacaatattaaaatattatcaccttcaacaagtgaataaatggacatttagatggttacaagcccaaattcttacagctaataaaggatagaacctggattcacactcacatgtcctggcttaaaaaccagtgtttttctacacaattatactatttcatggggaaaaaggtaagcagagttaaagcatacttttactctttgaagcagttcaataagggcagcacagcagtagttagggaatttgagatctacaggcttggctttcttactcagcatttattagctgagtggttttggactgcccacatacattcttagagtctccccagtagttcacggaatgtagagtgattattgcaaaagctgcaagaagccctagagatcagcctaccacagtagagagagtgcgggttttgaagtcggatggatcaggtgtgtgagtcagcatccaagcaggaagcagataacaccttcaaactatctgatctcttgctggtgactctacaccattaaaacttaatttatttaagtcagaaaactgaagccccaagagatgagttgaattgcccaagctctatggtgaatttggtacaaaaggaagataacagaagagctcaatgtccttccagcctagtgagctgaagaaccattttaaacagaggaaggctggcatatggatctggctcaaatcagaaatgtatgtgttttgggttataagcagatgtctaggtacctgagacaggttcctggtttttcaactggacgtacccaaacatctttgggggttattttagccagtttcagcctcactaaaggatgcagagcatgtactcctaggtggctcttagaagactggtagacatgaaaaacacataaaaggcaggtggtggtttgcagtgggcttgtcacacatgctcctgagcttggatagatgcagggctttgccaggagatggggctcacactgtttgtgggcccatatccttgatcttttgatgagctgttaaaaggtatctgtaattatcgagacccttggcacatttgccaagataaaaggcctttcaagtatattgctctggcagcattcccaaaaagaaaactatcttctacctgcattgcctcagagcactcaaacttgcaaagagaggaaataggtccaaatcccggctctgcgatataggggtatgtatggccttagacaattcatctgccatcttggggccttcgtatcttcatctgcaaaatggaaataatgagtaccattatgagtaataatgagtaacttcccagagttatgaagaagattgctgtcatagatgaaataggaaagtactgttgaaactgtgcaggcctggacaatagcattgttattttcttcctctgtaagtcaaagtccattttgctatcagttttcattccatgccctcgatgagtgcttgaggttaggggaaccatttccccagtctaccaggaaactcactgcagttatgggatgggtttaaagtagtctggaaatgctttgctgggtgattccatctcaaggggagatttatgccttattataaattgcaggaagagagaatcatcactgaagaataactataataaaaccaaatgcaatatgtataaagccattccctatgattagctcatcttagtagtgcccctgaattttcctttccactttcttaagaccctgttacccccatcagtcttgccattacccatttgttgtggagtcagggcagaggcggcagggacttacaggacctggaccttgcccatcagtttctaacactgtgacttcaacgctctcccctctccacatgatcctggaagctcctcaggggaattgacaagtcataattttctccccaagtacagatgctcggagaaagcctctctttgcctgctctgggtttctcattagcccccactataggatattcaagggtttctcatttctcatgttttatttacctcaaagcatctcctaatacatttgatcagaaaactcggttagctcaaattttttttgaagaccattatctgctggcattcctctcccaggctccttccctcagctcacctcttcactctgagtggtatttataaactcctcaacttctgaggcatttggaagacaccctcctttcttcctcccccagaccagttccctgatataatttttttctctttctcccactgccttcacactcaaagaaagggtttctcaaacgttttttctctggatctcttcaaaaaggcaagaatgttttcttatttgctcactcattcatttgttcgtatgttcattcatttgtgcattctatgtaatactgagcagccactgggtgccgggttaagatttgggatacggaggtaactaaaacaaacatggtctcacgtaagacttgcaatctagtcggggggacaggcaatttaaaaatccctcaaaagtgatttaattatcattatagtaagtgctaaaaataaaagctaagccatcttgggtactaattatgtgacaggcacggatccaagtgttttatgcatattaattcatttaagcctcgcaactatgctttgaggaagttaaaagaggagaggattagtgcccataaaacctgaagggcatagactccattagtaaatttgtgaatattggaatgaggatgatacaccaggacaagatgctaagagtttgcatagatgacatttatgtagcactttctgtttaccaggcaccatgctctatacctcatacacaggacttgaaccttcacaacagcaccatgaaagatcactatcattattttaagaatggggaaaatgagacgtagagagcctgagccactagtccaaagccacacattgtgtatatggtgactctgagagtatagcttaggtgcgtttgaccccaagtctaggctctcacccattatgttaacctgtgaaaagttgacattaaatattcctcatacagtttatgtcctggtaaatactggtaaaatggagggaaaaaatggatctttttatgtgtatctcaattagagccacaataatcgttcttgaaataaaatggaactttgtatgtactgagagtgtcgaatccttaacctttaagcatatttccatgtaacagcttcctgttcaaagggtgagctgaagaccagcagcgtgggcatcacctgggagcttgttaaaaatgcagagtctcaggttccatcccgacctattgagtattggaatctacgttttaatgatctccagatgatttgcatacacacttatgtttgagaagctcagatctagcacaagttaaaagaataggcttccagccctggttgtgatgctaactgaccagttgtttgacctgcccagattttctttgccttttcagtggaaatgacctcagctctcttcacagaggagtcaggaaccccccaacagaagagcctggggaggaagattccacagaaactcagagactcttttttacctctggaatcagtttctcactaagtagtccaaggaccacctacatgaaaatcatctggggagtttattaaaaatgatgttcagattaaaagtagacctgtcagaatggcaataaatgccaaaaatagggtgtcataatgtcttcaaacaccaagagaaaatggctgttagatgagaattgagtatctctcccaaggtgtttatctgggataaggatgcaataaagtcattatcagacaaacattaaatgacatctaaacttcacatttgattaatctccttttgggaggaactgacactggaatgggtactttggatccacccaaacttgaagttcaaatccttgctcccattacccactacctgtgtgacttttgagtgacttacgtttttgagcctccgttttctcgtctgttaaaagaggagcaaattctcaccattcaggaaagagagcagctcttttgaggttctttataacgtaaataagtatgtggtaaacagtactacaataaataaatcacaactattattattggttattcaacataaagagatttcacaaaaagttacttttaaattatctgtattatcatgatataatcattattgcagtagatagaaacctatttagaataacttttgaagtaatgtttaatttaatttagcatacagttcttgttacttcattcattaatttattcattcagtaaatgtttattaatagtctactaagtaccaggagcttgcccaaacactgggaatgcagtagtgttatatgctatatggaggggtgaaatgagggacagaaaatgttagatagaataagagctatagaaaaatacaaatcaggtaaaggggatgggctgttctttcaaatacatattttaataattgaattaaacagtaaatttatcagaagaaacttacagaaaaattttggaaataactatgtttacctttgtgagttttccaattttctctctaggttttcttttaaatgaaactcagtatttgaaaattttaaattgattcgaagcttgttgaccaaccaacaccacttcttctgcttcccagagaatgtgtaactattgcaggtttatgacccttaatacttaacaaaatcattcgttattttatgtgatactaacaatagccccatgaaacaaacaggtgaattgcatattgagttttccattaagggagagaaactatggctcaggaaggccatttccaatggatcagaattttaccactggttaatagggatgtgggagacacagacaaaggtcctcattctccaaattcaacttggactttaccacaggatctctacttatttgtcaatcccttgaaaacctcccataaaacaaaggtgagggctctggggtggcagagatctctgtgtgatgtgatgtgatgtgatgtgatgtgattattctgcatggtggggaatggttgaggttattgtaggtttaaactattaccattgcctaaatatgaaggtgttgaggataaaaacaaaataaatgatataaaggcaaatggaatttatgagccatggagcatcagcttcaagaaaatgttagacttatatgtggaaaacatattaggttataacggaattttccaaactcaactttacttaagttttagaatggaaagtttaaacattcaatccaaataagatcttttttaatactttctgattttaatttaggaataattttattcttactggccctaatttgacgttatagtttagtgaattctaccagctaagtgtccaataggtaccttgaaaatgttacctctctccttattctctctggtccacaaacaatgctattacttaataattgaaatatttgagccaatatgttaaaggagacaaaaatatcatttctaattattataactcttataggacaattagaataccactgggcttcaagagagcagtgtccatccctggactctagaatggcctgattaattttccagtcttattgaggttaaaattcacattacactgttcaaactctacttggaattatttctacagtgaaataatgacattttaaactatcataattggtcatgcctttgcttctttcacacacatgctgctacatttttcccccaactatgtttggagtatgaaatttgggaaagaataagaaacaccctaggatgttcggccatccttgatagtgatacaaatagctaaagtggtagtacaaatcatttcctaacgtatgtggctccaaagttctgacagggcagatgttcacccagaaatgggtcaacttagttgacaagtatggttgaagattattagttaaataagcctaaaaaagtccccaatttccctctctgattttgcttctgtacatagtcatgtttggggtgtgtgtgtgtgtgtgtgtgtgtgtgtgtggatcttcagatgttctcaaagtcaaatgtcaactgctttatcctgttcccgttaagtttattccaaagcagacctccaatatcaaggcccttcttttcttcctatattagtcaattttcacactgctgataaagaccttccacaagacttggcaatttgcaaaagaaagaggtttaatggactatcagttccacatggctggggaggcctcacaatcatggcagaaggcaaggggtagcaagtcacatcttagatggatggcagcaggcaaagagagagagagctcgtgcaggggaattcctctttttaaaaccatcagatatcatgagatttattcactatcacaagaacagcaggggaaagacttatctccatgattcaattacttcccactgggtccttcccacagcttgtgggaattcaagatgagatttggatggggacacagccaaatcatatcacctccctagtgtctaatacatggcatttggcatactgtaggcccttaagtatttgttgaataattgacaatcatttagaattcacactccgagcaaggagcattctgttgcatcagtacctttaagcctctccaggccaacttgctgggtgaagagtaaataatttgatgaaattggtcataaggatatgggaatgggatgggaggggtaaggattacagtttccatttttttgagcccttcaggcacaaggtagactatgttaaataaatttaatcattgaattctcacaacagccccgtgagacaggggatcaccctctcattttacaaagaaggaaacagaagacttgatgggtttagaaatttgtttaagagtgtggaactaggaagtgatggtgtaaactttactcccaggtgagctcaaacccaccatccatgctcttaaccactgcacaaactctttggaaaggagcagatctgattcatgatcacgcctctttccctgaggtcttgccgcttgtcccatcctggtgaacccactcttcatcctggctagtttctcattgttttttgttttctccccactccgatgcctttaagtcctcatcctcaaatccatcctgggataactgaagtgttccacttcaaatgaggaccaaacacgaatacaccaacaaaaactgccttttattttctatcagagttggtgggtccagagaagctctcctctttgcagcggggcctctgacctgggctgtcttgtgggtggcctagctgagtggtaagaagtcgctgtatatagtcataagctttgcctgtttctccctaagtggggctatcaccttccaagctaagaatgccttttgtagcttgccttgaagtacctctcgggaagttatctggtgccacgatgcatacttaaaatcctcttgttttccttctcgcaagataagaattaacttcctgatgaactcttcagtgctttctctttgagtaaactctgactacccctcccacaaggacagttttcaattccagacagctgatactttttattctagtcatgccattctattgaatttagatttccacttataatgatcctttttttattttttattttttattccttacgatcttaagatgtcactctttttcccctagaactttctaggatatttatgtctcaccaataagcattagcactgagaagtacagaaggttcattttaatgagctcttcaggatttgtcttgcatctgctgaaataaattagatcaaaataagattgaagagatcttcaagtgctgcaacacctaacaaactgattttattatttagataacaggaaaaagtgaaaagaactgaagtttaagaaaattaaatttgtgtacttagtgaaagatcagaagtctcagtggagaaaaattctaatttgtattacctacaaaagagggagaaggtcacctgaaaaattatacagacccacagagctcaaaccatattgtagacacattgaatatttagcgaactttggtccaggaagggagaagaccctactgctttgtctgagctcatgccttagaagtgtaagactacatgattaccttaatcttgggtgatgctttggatattactgataactcagacatgataaatttgatactgatttactctttttgcctttgtttacttgaaatgatagaattttctaaccctcttcttttgaattaatctctttcccagattctcatttaattttattcttaccttgtcttcctaatcccagttattcattcagctattattaaaatctgggtatcttgggcactaaactttgcttttgatatacgataaggtaattaaattgttgcatttaataaagtctcagaaatctgctagcaaaattaattcctccttgaatttatgtagtttactttcatggcactcttctctgcttcactatcttgacactctctcttggagtgtatgtatcagttagcttttgctgcataacaacacaacccaaaatttaatggcttaaaactacattatttatctaactcatgattctgtgggtcagcaatttggcctgagcttagctgggtagcatgtctgctgatcttgactgggcccactcatgtatctatggcgattctctgattaataaagtggttgttctttctaaggattagctatgtattgattagaaaaatgaggataattggaccccttacctgtcatcaagtgaactagcctgggcttgttctcatggcaatcaccaggttctaagcaagcaagcaaactgcaagatctcttacagcttaggcttggaactcagagaatgccacttgcacattctgttggtcaaagcaagtcacaagcccatcccagattcaagagttgaggaaatagattccacttcttggcaggagttgctccaaagtattacaattatttttacaatctgtctagcactcagtcatcatctctatgagtccaatcttcttaccttactgccagagcacactcacctgattatctcaatcttacctgagtttcaacctcttcaaaacaggcctaactattgtctctctttccttgtaacctatttctgtcagtaaaaagtgtcattttcccaggctcttaactgaaagtcctgtattcatgttacactctcctctccccactttctttatagccaaaaccaccaaatgctataagaatccttctgaagtatctctctatctctcctctcccgtcacttaagtttctccttgatctctttgtctcccattgttctttcattcaagacttccagcacaccccctcccaattaatctcacctatctcttctcttttctgctccaaaactttccactaattcactatgacaaattcaaccttctctgccagatacactacctgatttggcccaaattacctgtccagatttactcccactattcaccaatttggattttcatacctcagtgaaatgagacatttcactggcctcaatcactctataattgcttctatgcctttattcacactatgtttttctccatcctttttgacttttaaactctgacccacctccataactcagaccacatttccttctgcacagagccaaaggcaatagtcacagagatttctctccttcctgttctgttaggtaattaagcagcactacatattttgccatgtgattacgtttcatcctaaattatcccaatattcatgggcactagcattggctcctgcagcaaagtttggcctccttgagaataaacacatcacatcttcattttagattatccaggactcactggacagggtatgggcaaaatagatattcaacaaaacttatttcattgaattaaatctcaaatttcatttaatcatcccctttgtgaagatgatttttcctatcattttaagaagcagaaaagctatgtgattcatcaagttcaatatttaggggccccggaaaggaatatgggtccctaaactctgaactgattcacattctttacacagactctgtagtctcttaatactgacaaaacgatttctattacaccaagacagaggaaaatgctgccatccgtcattcagcaaagtcatctttgacacctccctcatccactgtcatccagttcagcactaaatcctgtccattttccctccacaatttccgtcaatctgtctacttctcttcatctccactctcacttcgctgtctgtctcagatgactgcaacatcccataaaagttctcactgttttctactcttctgcccactcacaccttcctccaagctattctccacatagcaaccagagaggtcatttctgaattcaagtctgctcatcctgcttaacacatttgagtaaatttgcattgctgttagattaaaggtcatatccttagcagatccataaaaccctgcagcatctagccattgactgtctctccagattatatcttcctgtaatgccccttacatcactgctttatgcagcccagttcctcaaatacaccaggatccatcctcccacagagtctttacatgtaccgtaatttccaccagaacactcttctcaccctgactgcccttcattcatttctatgcatcctttgggcaactcaaattattttgctgattacttaatcaatgtctctcctccatcaaactataacctccttgaagccagaaagcctctttggtttttagcacttgaactgagtcttaaaacccaaagatgaagaacataatccaggcaaagacaacagcataggtgaggattggtagaccaaaaaaaaaaaaaaaaaaaaaaagccaagattggtttgtaaggcaatattgcaagtaatttgctatttgcaaagacaatgagagaggaggctagaggggaaagcaaggacttgaagaccgaaagccttgaatgccatgctaaggaacttagaatctatctggcaggcaatggaggacaactgaatggtgaaaagtggggaaaaggaggcgacacagtcagacttgtattctggaaagacagcccttgtggcagcatggatatagatgtttgggggcaaggctggaggcaggtacagctgacaagaccaccactctgggcaaatgatgatagtggcctgaactaaggcactagcaggcaaatacagagatgtacacagatataatcaatattatgaatgtggaactaacaaagctaggtaacttactgaatgagatgatggaaagagacatgcaggatgactctcaggtttgttttttttttactttgggaggtaccatgggctgcgcttgggcacatctcaaataagactattcccatgatttctaggaaatatcctaaaaggagcatagcctttagatgctttttaaaccttacatcctaatgccatacccaggcagaaattctcatagtacatgataaatgggtttgttgattcatttctaatgtttcattggacttgtagcattaagaaatgagaacattataataatcattatcattaaagagatccacttcctatgaagcacattctacattacccagctcctcctactccctctggcatttgtctaccagttctttccaggaaacgtaaacacataaatgaatcaaagtcaagcagcagctgcctccttttactcgagcaagtctgacatcttcttacatctttgtcctgggctttttctgaatttgtgtcaaaacatttcttctaattctatccccacaaaccactggttctgttagggatttgtatcccatcccagcatctgtgaaatacagtggtgaggctgagtggcatccaaagaaatctaggtccctccaagttctcaccctatgccaggctctgcttgtctttacttcaatgtatggatgcagttcaagataagaagggtgtctctggatttggctaagaactcaagagaggtggtcctgggctcaactccttgctttaccacttattctgcatgtgatgttacagaagttaccatgctatgaacctcagtttccccagccgtagaacagagataatacccatcttgcaggtatgttgggaagatcgtttgagattatggatgtaaagcagtttcttcaggacctggaacatagtaaatgctccccaaacattagttgttcttttgattataagtattttattattaataattaccaaagagtgacttataaagaaataacaaatatccagaatccttaggaagacccatcccgtcttgcctcaagcctcctctcatgctatgcttcctcttggccactgcagccacagtagcttcctttcctttccccaagcctgtcaagttcttgcccttcacagaattttctgtctgagtctgcattcatctatgtctaactcttttcaagactagctccttttctgtcttttgggccagacagacccttcctcaaagaagccttccttgttcaccttatctgagaagaccccactgttgttctctaccattgtacctccttgtaccttaatttcctttatcacaattttatttttatttgcctattcatttcttgctatatacataaataaatacgcatacacccagtacctacacaatgcctcctactttgtgtgcagtcaataaatatttacactgaaaagatgttcattttttattttaagaaaaatgtctgcatacctctgataaaacaaattggatacagactgtccccaaaagagccatagatcaaataaaaccttgaagtcagtggtgtgaatttacattcattaacctccaatttaggtcgctgagttatactttattcccaggacatgagtactagcttcctaaagtcattgataacagaggtcatgggaagatgcccctcctaaattgtacactgatataaaatgggctgagatttatctctttggaatgatgatatcctcttcatctattatgactgggaagagatgaaaacattagactggaaaattgttatttgcatacttcagtgtgcatccattataatatgcagttacaaccaatctctgctaaggaagtcaaaacaccataaaattttgatgccctcaaccagcctgttgagcattgttttcagtttcctgtaaggggaaggtgcttgtgtgaacatacaggccctggccaccagggaaatgagtggtgaatggatgttgggttccactgttcctgtcaggctcctttgctctgcagatgcacaattcagctgccactgatatgatgttttggccactacaaatcacagtcctcagagactaggctattccattagaaataaattctatgccacccatagttactgaggtctcatgtgtgccagtgggtttctcagaaggattctgtcactttcttttacagtcgagggaaaaaggtacagctatgtcactttactgtggaacattttattttaccgttgcaatgaagtgattttcattcaggacagctcccttctaagaagcagactggctcaaaaaatccagatcctggattttcttaatagatacagttttggtgcacatggaaataacaaaaatggaactggtgacatgattctaaaggacctgatttatggtaaatatccaagaaaagtggaaggtgtgaaatcagaaacctaagtggacagtagatctggaaagttccttggaaatagtagctgccccaaaagtagctgtgaatgaatgtgagggataggttttcaaaggaggcatccatagtccatcaccagttgtgtcaccttataagttgtgcttctctgtcagagcagaagttcttaggctgaggtccttgaatctctgggttggtctgttagagaatcctgagaagtatctgaatccaccatgtccgcatgacaattttttaatatatgcacacatgaaaaattttctatggagtaagtccatagctttcaggaggtttccaaaggggaaactaagcttaaacaccagcccacagatactcctcatctcctctcatcaggactttcctagatgaccaccatcaaattttctcccaaacaagttcatcttattccaacttccaagataatctcacaccttggaatcttgtcattcaatttttgtaaattttatttatctatttttttgtaatgttgattctgcttcctttcacttatatgtcttcacattttatgtagatgccttttttcgtaacatttagttctacttttgtctcttacgtaaccacttctagtagaccaaagtaccactaaggcactttcatatacacttgtgagtttcaccctgtttagagtaaagaagggatgcatttccaattcaacaaattaatattaaatgcttgctatgagttgtgcattgtgtttgctctgatgctagttctgtcatgttgatttttatttactttctgcaaagaactttttctctaattttttttcctactttttaacttacctctactgcctatttgactggagttttgctctgggcttactggccctcattgaagaatttaatttacaaacactcccactgtatgggggttgcagagatgaacaaaggatggtccctgcctcaaagggctttcaaccaggcaaggaaaattatgtaattgcatcctgcattctttgtaattcttaattgtttcatttttacttaatttattttcacctcttccgaaggtattccactttttttctacttcctcaaatacctaatcttcacatcttcctttactaagaataagatccttttgcataagaccctcaatttcccttttttccaactcagcgtaacttctcggagccccatccaatgcctccttcttatctcttagagaaagaattatctctcatgttttcatcagacacatactttctgggcaactactacttgcaaggcacttcccacttacatttcttttcccacatcttccagttttctccagctcatgcaaatcatttcttttagaattgtgtcactaatttttgcatcattgtctttggttcccatcaacaaataggatgtctctgacagtattttaaccttgctagatgtgttaaaaagcagtatacatttaatttgggagcccaaagctaaattattttaaaaaggtgactctgtcttttagttacagaatcactagatggctccatccctgcagtctcttctgcagtgctggagttgatgggatacttatgtctatgctcattagtgtgttccatgtgaactccacttatcactggtactcagaaactaaaaccaatatattaaacattaagtaatttgatacattttattgcctcttagatttaatcaatagaaagacattattgaaagatggcgaggatcttcatcttattgcctaaaaaataatgtcttttacatggaatataaagccctttaggctatggtgatccttcatttcattaaaatataatgagaaaaagctactctcccataatgaggcagaactaaatgggtccttagcacaatcaataaaagattattaacaaagaaaattttgttaaagaaaagagaataaattttcttctacatcctacaatagtataataatagaagagagtgaaatttccttactttaaggaatgttcctctagggaatctagattaatactatttttgaatattctttaaaaagcatgaaaactatatatattgaacaaaaaactattggattttgtctatacatatatattcacttatagattgcttaataatctgatcttaattttaaaaaattttaatgaaaaatttcaaacatatataaagaaacacaaaataatattatgagcctctgcttctttgttgtctagccaaaaataattacctcacaggcaatgttgttccttttatactgtcatccttacattctccccaggcatatatctttcctcccataaacaaattgctatgtatctctcaaaggtatttaaaacaaaaataccacaatatatcacgtacaaaaattggcaataattcaatgtcatcaaatatctacacatttccaaatgtttcacttaatctcatatttttatagtttattgaatctaaattttttttttaattcacacattgtaattggttgatacgtcccttaagacctttttggttttttaactttattttaagctcgggggtatgtgtgcaagtttgtgacataggtaaatttgtgtcacagggatttgttgtacagattatttcatcacccaggtgttaaccctagtacccattagttacttttcctgatcctctctctcctcctactctctactctctgaaaggacccagtgtgtgttgttctcctctatgtgtccatgtgttctcatcatttagctcctacttataagtaagaacatgcagtatttggttttctgttcctgtgttagtttgctaaggacgatagcctcctactccttttaatctagacgttcctctctctctctctctctcacctcctttctctttttcttttctcttttggactttctgtagtttgctgttgtacttaaataaacaaggtgcttcccctagagaacttctcagggcctgggttttgctgatttcattcttgcggtgtcatttcacatcttcttctctctcctatattccctataaatttactgttggacatagaggcttgcacaaattcaggatttgtttttttttttctttttgctaagaatacttcattattggtgtggtcatcttcctttagtggtatgtaacatctggttgcctctctttttgtgatattagacatcagtgcttagacttattaattcatgaaaggttgtgtgttagccagctcaggctgctataacaaaatactagactgggtggtttaaagaacagaaatttatttcttgcagttctgaacactgggaatccaagctgaaggtgctggcaagctgaaggtgctaaggcctcttctctcagcctgtggagagggacagagaaagtgtcagctctctggtgtctcttcttataagggcactaatcctatcaaatcgggcctcatccttatgacttcatttaactttaattactaccttagtggccccatctcaaaatacagacacactgggggttgggactttgacatgcaaatttgggagggatacaaacactcagtccaaaacaagttgcaaaaccttgatattctattatttcttcttcattattagctgaatacttttatttatttatttattcatttgtttatttttgttttgagatggggactcactctgctgcctaggccagagtgtggtggtgcaatcacagctcactgcagccttaacccctcaggctcacgtcatcctcccacctgagcctcccaagtagttgggactacaggcgcatgccacccagctgagctaacttactttattttatttaatttatttattttgtagagatgggggtctcactatgttgctcaggctgagctgaagacttttatgtagagaatgtcttctcttctacactttggtcacctgccagtagtgttcttaaagaatgagcaagatacaggattaattccttaatttaccagtttttaaactaatgaatttgttccctagtattttctaacagcgaccaattcaattttttgggttacttgctccttttggtatagttataaactcatgaatttaaactatctttatctgtgtggccttggataaatcacttaatccctctaagccatggtttacatagctctaaaatggtgataatgatggtactcacctcacagagttatgagatttcaatgatatgatgtctgtaaagcacttggcacattgccagatacaaacagaagctcactaagtagcagcagcagttgttgtggttattgtgataagaattataagcagaaaataccacataacaatatgcttaaacctgctcatctggaatgtctgctcttgtattttgaaaatttttcaatatcaacgctgccttttaactgtctattttagtttcgtttcttctcctttacacaatccaaatgcattgtaacaagttcctgttattggagagagatgatttgatgaccacgcatcatgtctgagaggttcaaacatcaattttcaggttaagaatcagaataatcaggctgggcacggtggctcacacctgtaatcccagcagtttgggaggttgaggcgggcacatcacctgaggttgggagtttgagaccaccctgaccaacatggagaaaccccatctctactaaaaatacaaaattagccaggcgtggtggcacatgcgtcccagctacgtgggaggctgaggcaggagaattgcttgaacccaggaggtggaggttgcagtgagcagagatggtgccgttgcactccagcctgggcaacaagagcaaaactccatctcaaaaaaaaaaaaaaaaaaaagaatcagaataatcaaaacgagtccatgaatgtctcgaagtagaagcagtgtagagatgcaacttgccagtatggtgttcaaaggaggtagaatgtagaaaggtttttaaatctttagacacatttatttgcatgtttcaaaattcttctgataataaatggtcctatgaatgattctgggttgctacctcttagcttatgagcttaagtgtgatgttatttatacttgtggcctgtagctggtaagctctggattctatttaatatacctgcaaagcacacacacacacacacacacacaaatgcttaagggccacgtggtggctcacgcctgtaatctcaacactatgggaggccgaggcaggcgtttgagatcaggagtttgagatcagcctggctaacatgttgaaaccccatgtctactaaaaatacaaagattaaccgggtgtggtggtgcatgtttgtaatcccagctacttgggaggctgaggcgtgaggatggcttgaacccagcaggcagaatttacagtgagccaagaacatgctgctgcactccaggctgagtgacagagggagattctgtctcaaaaacatacaaacaaacaaacaaacaaacctcctactattctgataatggatgctgtgcttatctttcactaaggtaaagctgaataaacatttttttttaaaaaaaggaggaaggataagtgacatttctttgcttaatgactcttattgtctagtgaaaaggcattaattgaatacagccaattgattatagatcaattttttttccagaataaccctatggtattctaaattgctctatggatacaaatacaactgtgattgataaaatatttaaattttaaaaaagacatgccaaatgtattgaattcagccagaactgaatcccgatgggaatttatttcctattcagagaacgctgcacatggcaatctgaggcctattctaaagtataaggggaggaggaagttgagggttgtgacttatcttcagtttttaaaaaattcagtcattctgtattatcatgaaagcacagcttctggcaaggggtagttcattccagcatatccgatgcatgctatttaactacagaacagtagctgtgtgcatgagctcatcatgctctaatttttctatcaagcagaagtatacagttaaggtatctatcatcactgattttcttcaatgcactaagatatggttatggtaggttagaaacttcaggaagtccatatcacaaatttacccaagaaaaataccaagttcaaaaacactaccataggcaagaaattaattcagaagactctctctaatcaggtgtcagagaaatggtgtcagctctgctgaatttttattttatcttattattccattttgacaaatatgagagaattggagttgattcctttaaaggtaattattcctattcaacccgatggaagttgccctttttaatcaacgaatgattgatgctatactttagccatatgttctgatggtgtattttgaaatatttttaccctgattctaaagagagatgttgccaaaatattttattaaataagcaggtcaaaaatgttcttccactttatagtctctgtaaatataataaatttgaaagtactattgaagataattccaaagggagtggatttctttaactttacatttttcatccaaacgaaagtgaaaacagcacatccatctaatgacagttctgaatttacttttctcaagttacccagatgttgtctacatttatgattttaagaaaatcagtttttagttacaaaagttatacatgcttattggaagacattgcaataatgcaaaaataactaaaaccgagattctgactctaacttctactccttagtggttacaactaataacacttcagcattatgtttctagacctcttaaatttctgtaaaaaagtatatactgtatgtatatgtagaaatattttcttttacaaaaatgcaatacatgtatttactttttttgctttaaaaagattataaacaacttccaacttttctgtactgctactcattctttttaacccttgcataatattgattggatacctcataatttaattactctatttttttataggaatgaaaatcacttccaaattgttattaccatttctgccatgtgttgttttattttaaagatttgtatcaggcttcatgtggaaaaatataattcaagcagaaatttaaatttcaattgataggcaagagttcaatttagctcattgcataaaggcacagggctgtctaggaagtatctagtgaaaaagaaatgactggatcttgcatgggcttgacaatgctgtgtttcctttataatatgacttggaagcttgttttatttctgccagctttctctcatcagtttctgtgtcagacagtggaggctaactgactcaacaatcatcccaaccctcttcctcttgcccacctcccctataagactcaggaaagctgaagattcacttcctagtctcctatgcagtgaaaggtgttcaggaacacagcagccattttgtgacaatgaggcaaagactgtaagaatcaaagaaatgacccagacatcatcaataccagtagtcacctagctctagacttcctgatatgtgtgaaaaacaaacccctatttgtttaaggccccgtaggtcagactttctgttatctacagccaaatattctgccatgtggtgcagtccccagactagtcatttcagaaaatgaaaacagaaacttcttttgccatgtaagtaacttggagttttccttctgtagggcctattctgaattccccagttgatggcatgaagtatcaattctgtaaggctgcttttgcctgagaagatttcacacaaatcacaaagcagttagaagggcacggtattcaatttttgacaggtagcatgaaatggaatgcaggatggaccacattggggccatttaagagcacaggtagttatatattgtagacaggaaaacacacatagctctgtggaggaaagccttttaacaatacttctcagtgcctccaaataaaagacaattgcatgtcttccagggacaacttgcagtttttatcttcacatgaagttcccatctgaggttttacaaggttattcacaaaagccttctgggtcaaagtattatacacccatagcagtaaccataaactgatggctgagaaaatgactggtcaatttccttagaaaaatacgattatcagtaggagaagaaaaactaaaagaaagaattagacaaagatcagtaggaatggaacattaagctttagaggcattcatctgtctactgggggcctcctgtatagggagtggagcatgagggaggccgcagttaacaaaacctttctgcgctggaaaatatcctgacagtacatattcctcgcttttttatggctactattgaggtaatcagctttgttcccagaaatgccctttgggggtgttgaggactaatcatcagttcaagacaaatcatgaaaggagatgggacaagagggggacatcaaagcagggaggagggggaggctctgggcctctttaacctatgagctgttgaattgtgaagctgcatgaaagtgaggaacctggcacccttagctgtgggtggctgacaattaggaggaggaacttgtcaagtgtaattggcataacctactcacatcaggcttttcaaatattcctatcatgccagactaactccctccccacggcagcctgcgatgctgcggagtggaggcttgggtgttgctgaggcacagtacgtgagctaccacctgcagcaatggggacgatcagggctttgtcttacagatgcttcatgtagccctcatctgactttctgaacattgatgtgacagagaaggcctcagttagaaagcccatcttcaatatttctgtatgagtctttccacagtgtgctccatcagagagagacccttttcacactcctgggcgagttgggaagaaggaagacactttagagaaaggcagacctgactgcttcacttaggagtagatcatgtgaccttggacttgctgtttaacctctgtttcctcatctgtaaaatgaggggttatatttctactttaggatgttgttgagaggattaaataagccaatgtaatgatggacttactgaggagactgacacagaaaactaaatataattattttattattactatcatcatcatcattacaatgttactattcagttacacagtgctaaaatgccccttttcaagcacttcatccttctattgcccattccttcatatatttgcttactcaataaaatttgtgagccaccgacaatgttttggcccaaatggggaatacaaagatgctgaagcatggtcctgttggcaaaggatttgcctattgtctggggaagtaagacacttccttatcttccaccttccgccaatccacttaccagtgtaatcagtgtggcctttctaaactgcaatttttttaatgcctctcccttgctgaaaacctattctgcttgcaagacccacgtgtcttcacattgacaaactatttctgtaagagtcagatagtaaatatgtttggctttgcagaccacaggctgtctgttataagtgctcaactttgtcatcagagcatgaaagcatccataaatagatgaagagatgaggctggatatggccacgggctgtcgtttttggatccctggtagcccatacctgacatatttctgcctgcctcttaaactgagtaactctcttctttttctcttacaacatatgcagacttaccaaatgcacagcccaaatgtgccacacttgctcatttgtgtgtctttgacttactcctctctgcctaaaacacccttctccctcttacctggataactcaggcccattttcctggtttctgcttagctatccattcctccagacagctatgtcccccttccctcccctgcaattatataccacatattcccctaacgtgctccaatttctgccaccacagtaaagcaccattgcagtgcctgttcattagcttgtctgtgtcttgaaatagacagcaagttccctggaggtaggggaaggatattgattgattgattgattgattgattgtatttctttttagttcaacaagcatttagggagcaccaacttcatgccaagcactgtgcaaggtggtagagattcagcaataaacaaaaacaagtgtattgccttttcttagggaagtggtaaaacaaagcataagcaaaggattaaataataccaaacacatacctatatttaaaagtctgctcgtgttaaaaaatagaataatgggagccgaggtgggtgtgtactaaaatgaggaagcctagttagtgtagtcaaagatttcctccttaaaaaagaaaagaaaggatgagaagaaacccttcgtgcaaaccatgtgaggacagaagtttcagctgaaggagacagacagcatgaaggtcctacagctggagggagctcagtttatttggagacagccagagagactagaatgcggtaagctagaagctgagatcaggtggttagggaaatatgactcctttgttatcatagtcctgggtacttgtagtgcctgcaaagtaaaatgtgcccactcagttactgtttgataactgtcttagtcatgtttcccaaaaggagattctgagacgagaattttggttcaataagtttatttggggagcaatgatgggaagcacaatgacaagtgggcggtgggatggggaaggaaggaaagccagccaacgatgtgtggtgagcaggttgcttctgtgggaaactggggctcggtctcaatgagcaccctctgaacacacctcaaaattgtcccccaaaagggcaagaacattggagattttacccaccaatttccttctcacactgtttgaaagctgccagggaattagctcctggggacgtctaccttgctccagtctcaggccaagcacacgtatgctagctgtgaatgccctcggcagagaaattcaggtatgtgaggaaggaagtctttggtgtgtatgaggactgaccccatgaagctgcagctatcagcagggcatcaacagcctctgctataataactaactaaataagtgagtaagtaattgagtggatgaatgagtgaatgaatgattatacctaatggaaaaggagtgaatcaacaaaacaagcccaaagtgaatgaaggtccctggcccaagtgagtaccttggtggcaatggagttgtgtagatctcctcctggtccaaatttagaggcagtatgttcatagcttggaattggccatggtggaaatacttgcactgtggaaactggcaaatgctataaaacacagctttattcctgggagatttgtttgttggcaaactcaacttagtggtaccaaccacttggtctcagtctccaaactgagtggtaccaactacttggtttcaatctcccaaccccttacctaccagtctcctgactcttgtttcttccaggattggtacatgaaggttgtgtaccaggccttgggagatgtcccctccctgacttcactgcagaccaagcatccctacaagtgccattaatcagcctgattttctgtcctcctccaacctattgcatttaactatgacttgcaaattaaccagaaggattaatatcacctttcattgatattccgtgtgtggttctattagcacacaaggattgagctgcttgcccttttcccaggggaaaacctttgatgtcactaactgcaaagatatcgttactgctatgggtgattttggtttatggatgactattaagctagaaaacacaggacaattttgttctgttccacctaaatgcatttctaatcaggctgcatagaaggggattctctgttggctgatcctgtcaattttgagagtaattttttgtaaggaacagagccgtagatcatctaagacagtagtgaaatgagagttcattgcaggtgatttattttggtctcctgaactcaagggaggtgaatgattgggccagtggttatgatattgattatattagaatgtgctggagggtgaggtgtctgctttgtttgaggagtatcaggagcttaagaaaagatgggaatacagaggttttataattctacttgaatgggtaaatggacttttgcccctgggttacaccttcaatgtctggtaaggtgagctagtgcaccacattaacagaaagaaggcactgtgctggctgaagatagatgtgtggagcctagaatttgaagagcatagcgcgcacacacaccaccatgtctttacatctctcatcaacttgcttatagtattacagagtcatcctcaaatggagatctgtctctctagttcctctatctcacttatttctacaccaaccccctcacactgtcccctcaggcttttctcactccttagccttccaggtctcacccccagttttcattccatcctggctatataacagaaagttattctatcttttctgtctctccaaaggggaaattgtctacattaggaattgcacttagttttgcagaactgagcatctgcaagacaaaccttctcagctgctagcattaatggcctctcgagcatcagtggtcaagcaaggaataccatgtctctttatgtcttccaaggtcctccttctaaattcttccaccccaccaagcgtaaaaagtggaagaaaggtagggaggaagaaagagaaggagagagagaggaaggaaggaagaatagaggaagggagggagggaggaagggaggggggaggaaggaaggaaggaaggaaggaaggaaggaaggaagggagggagggagggagggagggagggaaggaagggaagggagggaagcaagggaaggaaggaaggagggaagggaagggaaggaaggaaggaaaggagggagagaagaaggaaggaaggaagggagggagggaaggaagggaagggagggaaggaagggaagggagggaagcaagggaaggaagggaaggaaggaaggagggaagggaagggaaggaaggaaggaaaggagggagagaagaaggaaggaagggagggagggagagaagaaggaaggaaagaaagataaaaaggacaaatcacctactctgctttggtaatgagcttccagataatgtgattttgagacactcaggagaaacatggagaacctcaggtcatcaaagcacccatggtgcatttctgggtgaagaagactggaccatttgagaatcaactcttaccgatgtggcaaaaaaacatcattcttcccccaaccatagagctaattagaatcctaacttgggaagtctagagacccaggatcctactttcaactctcattttttgcggggcttcccctcactcatcttccaggtgttagcttaaatgtaacacccccccaggtataacctcctgtccagaataactcccctcaaaacgtgaaacacaatttgagattattttatttgtatgtgctttttgattgtgtctcccatatctagcattaagccccatggtgggtgggaaacttccttatccttgtcttttctgtgactatttaatttttctgttccccaacagctggcacatagcaaatctgtcattaaacatccaatgattgaagcatgttagtcttgatttggtagatgtgggaactgaggtttagagaagtgaagtgatttgcccggtgtcacacagctaggaaatgggctcaagcttaggtctgcctcaccccagaactgctctgctcccccatgtaaggaggaatggttgggcgagtaactgggaggggaatcagtgggaagatttctgaagtcccctcccactctttcaaggcaacacctagagaatctcaggcccctggagagcctccagtcccctctcctcactgtgtcttgatgtattccaattacgggaccaggccactggcagattttctctggaggagttgatttcacgctccaaaatacagaaggatctgactcttccagtgttatacagacatcgtatgttcaatcctcaccaaacccatgtgaatttaatatcaatcatatagtatgatttccctttaagcagttgtcatgctcagggtcaggttcctgccccagctgagggcagaggggagtgggtggatgtgaggcagggagctagaagaacacttgagagatagcaggtaaatgagacatggctttattcagcagctctctcatcagcagcttactcacacctttatctcggctgcctgctctggctcttcagctcgtctaagcagctggctcccatgcacagctgcatggccagcctgcaaggccagctctagggttagcagcttaactctatttctgggcacgagcaagccgagccacgtgctggctccccactgtccatctgctagatattcattctcccttacagggatcagtagcttcactttttctctgggtgcctgcacctgcacaagagccatgttgggcccaagagcatgtcagcagggaagttacaccttttccagacaatagcggctttgagccaagtatgagcttacacaaatagggtatataactagtggagtatgcgcctgcactctaaacttgctaagtcatgcaggcctggatgtctgcctcagcctgttcgttgatcaaagtacatccatgtaccttacagcagtgaggactatggggaagggagaaatgtaacctggaagcccataggtatcatatttaactcaattacaatgccttgtgttttcagaggtcaagagaagtaaaaagaaaaaattgtggtgtatgtggtttcaatagtcatgacacctcctttccacgtatctaacattttgaactagttaaatacataactatcattccttcttaagtttattatatgatggtattaataataccttactgtatataaagcacttaatataagatgaaaagccaaggtagtttctttatagctgttgagcactgaaatggacaagatttgtttttatatccttcaattccaatttgttacattttaacgtctcaaggatttttttgaatgaagcattttgaaacaattatgttattctaccatatctttcctataggaatattaagcttcacgcacacatgcctcacaatattgttgccactaggaaatatgaccatgtatgttacatgctggacacaatgcttggcccatagtaggcactttaaaatggtcacaatgtacaatcccttcttacttttatgtgcacaattgcctatcacacacttatgactcctgcccccagagaaatgtaaatatcacacaaatctctgcatgaattggaagagggtagcatgtaaatacatattccgtctcacttagttttctcagcgattcagagagacataggggttatccctgttttacagatgaggaaacttggagacagaaagggctagctccattgccacggcatggggctttcgactccatcattccattctttcttaccaaagacactatcttgacgtggcccaaagggttgggacatccagtgttggctgatgaaaactagaattaagcattgaaccattaaaatcaccttctctttatttctattaatactactaatactaattgcttacaggaagagagcatttggtcatgaggagtaagcaagtccacaccaggggcctaaagatggggttcccttcagcttcagcattctgtgtctcaaccctagattgtggagcgacctagaatagcttctgaatgcttcatcaaatcctgtgcaacgaaagctaacaaagttaaaaagatcagtttttctggactgcttggatgttggctcactggggcagacagccagacagatttggctagggattaagcctaaatttcctattttatggcctggaacatcttattaaggagcatctgctatttacagtaatattcgttaacattgattgagagcttacgcagtgccaggacctgttctaaattctttccacatattaacacattttactcttactacaatccttatatcttttggtcaagttctttccattttaaaaatacagattttaaaaactagtcacttaaaactgccacacacatgcacacacacatacacacacacacacgtgactcacaaaatattgctttgcctgtgaaggtttcacaatgccttgttatcgtcagccagtctttttctattaaagataaatggccaattgagacaaaacaattctgaggctttttttctacccttgattaagattgaggtggcaggagttatagataatattcatttcaccttctgaactttctggaaagacctggtgatcttgccagctccagcagccttcttgtccacagcaactgtctgtgtcacaccgcaaatagcaaaatgacccagaagagttaacatcaatgctatttttcagtgaggaaatcaagacatgaggaaattaagcagctttcccaaggtcacattccagagcccttgaccccagttgacttctgtgcaataactcctctcactatgcaaaatgagctggtgtttccagtagtgaccccaaactattgtaagaagctgaattccaaagttaagataaattggaatactgcagcatgttagtgttaggtgcatttgatcgacttcctttagaaatgaccaagaaattcttttgagcttagccaaattatgaaatgaacaaagtttagcatttgcttatgtcccctcttaggccatcctgtcttccaagtgtctcttctttctaggagacctctcagagtccctgctcctaattattggtgcctggttccccacagattcacattctacaccaggatagaccatgacattaactgttgaaacttttaatagttgacttagaaacagcaaccaacacagagatgtaaccaccagtgaaagttggaagctgaaatatactgagatcttgtgctctaaaatagcacctcttagaaactcacctactcttcctcaaactcagctctagaattctccgaccatgactttgaaatattgatgtatattattccaaaagacaaatcatattatggtagaaaataaagacaaacaaagagaagaaagcaaggatacacccccacatcttcctacctggagacatccattattaactagttggtgtagtgctatccaggcctttgactatgggattatgcctctcccctctgagacacgacagctctttacacactcaaacacagctattttggctttgtctttaattattctccaagccacatttctttcacttgccagacaattattttagacaccatgtccccagtcctcactccattctaccttcatcttccagctgaaccaagggcaatgctcttcttcagaaggaccataaattccctcaatccagacattaagctccttttgatatatctcattagagcaacatcatcctaataactgccttctatttgtttaattgttctccacagctttttgcaatctttgcatttgcaacatgcggtggctattctggaggcctgcggctgagtgtggactgcgtcaacaagacagaaagtaacctcagcatcgacatagcgtttgcctacccattcaggtagggaatggtggttcatgcttgttagcctcacagggggttatttctttcttctgtgctttgtctcagaaaaaatgcagtcttccagggacttctgggtaaacagaaagtattctgcctgcacccacggaatgcccaaacacagtgcccactcaccacctagtgtgggcactgggaggatttatgagttgtgccttcaagacagaactgactctcctcaaaaaaaaagaaaaaatacttgctacaaagagaaggagggagggaaaaagaaagggagattggagaagtaattttaaaatacgatcaaataaattcaagaaatatttttagcactgtgcctttctaatgcacattttgaaatcaacaagaatgacagattgtttcccaaatacatttgactgtagaaacttcttcttcactgagtatccaagaggatctgtatactatggaacacatccttaatatttatatattaagtgtatatatatatatatatgtgtgtgtgtgtgtgtgtgtatacatataaagtgaactgttcctagtctaagacaaagatgactcagttcataggtgatgaatcatcatagagacgtagcattgataccaatattcttaatagtttttaagagtagagctgacaaaagttgcaaataccttgctcaagtagatactctcctaactaactaataaaagagtagaaagctcagaaatattaagcacgtaatccctgaaaatttagtacaaagtgctgtgctgtgctggtggaagtggacgtgcaagtgcatgacttctgaaagctctggaccaacccattggcttctggaggagagtggccaagccaacgcatgctttcagattaacatgcaggatctaggacaggagatgaaaactgccaatggccgggcagcggggctgggatgcttggtaacattatacatgagatcataagctcggcatggcttctacagtgatttcccactaagagatgtggcaggagcaggtaacttaaaagtcaatctctcaagatttaaaagtcagcaagtctctaaacattgaactaccagagcccaggactctcagtcttttcctcaaactggaggagagtaatcaagagacctatctgaactggaagagtgcctgagctggtgtggcggtggagagcagggtaatatctaatttcataaaatccctgcttaaggatacaatgtgagaagacacttcaagcacagtttcctgcactgggcttctttaatttcttcccaagactacaaattcaaatgattggcccagtgaaaggcaactagagaaattagatcaaaatgtattgccatctatagcagccccctcatttaaaagatttttacctgggttctgaaacaaatatagttaatcattatattttttagtagcacagcttttctttctaacattatctcactcagaagctccatgtataaaatagacatgagtcactgagaaagttggagcaggagaagaagggagcttaatgccaccagccagtcctcctcaaccttctccctgccacacaccttgcccactccccaccgtacagcccctgtaagatctcctgggaaccctaggtctcctagaaacaattttaaaaccactgttctaggatttagcaagaaatcgtttgccactttgcttaccacatcttacatttactgtctactgttaaggaagcagtattagccaatctccttttacagaatgtcttgtacttttgcccccattaatgttcatctaggagatatacacaccattccaaaacagcttaatttactagggttgcaatttcaattttacatttgtatattttaacatgtaccattatccatgtacatattcataacctgtaccattatggggaaaatctcagtaataagccaggatttatacagactattatgaagacatttgtttcagaagaagtacggttagcaagatgctggtaatataaataattaaaaagtaaaaagtgataatatccactattataaagggtggagagaaatgtagattctcacatgtggttggaaataatgtatattgataaagcctttttggaggacaactggaagtaggtatcaagatttaaatgtacattctatttaatccagcaataccatttctagatatctaccttcaaaaatgttcatataaatacacaaatatatgcatgtaatgcatgtaatatgcatgtaatgatgtgcactgcagtgttgttaataataaaagactgaaacaaacctgaatgtccatcagcaggaagcaggctcagtgaatgatttacatatgtcctaggcagaagttttaaaagtgaatgtacagatatagaaagatgtttaaaatgtattactaaagagaaagtaagtagcagcatgttaagaaaaaatataatagtaaatgcacaatataattttaaatttatgcacctatatgtatgtgtgtgtatgtgtatgtatatgtgtgtaaaatataaattctggaaggatacagacaaacagttaacagggattacttttggggaaggatgtgtcattggtttgcagaggtcatacatttacttttaactctacatacttgagtattatttgaatttattaaaatacacatatgataccttggtaattttaaaaacgctctttaaaaatgagtcatcctatggcttccagtgagatgaaatgataagacacagcttctggagagaaataacttacaggaaccccatctgaaattccaaatggattgaagtaggtgaaaaaaatctgtattttcaaggtgaatggcaagaagcagctgttgagacaactcagcaatttgaagtaggagattataaaagcattgcttatgcttaaaaaagttattttcttctaaaatgtcacaagccaatgccaatgatttgatgataatcttagaaataaggtaagaacattcagtagcttttaactattcagtgtattgcaaagagcaaaaggacaataaactcaagtcatttgaacaaaaacaattagtttgtaaatgatacatcaaaggaagctacttaaccagttatcagacacatattttaggatgtaagataatgtcagtgttaaaaattctagataactcacaaagtaataatgtgcttcttctaataaatatgccgaagtgcatatctcctttacagcaccatatgtatgtgttcctgattcctatcagaaataattgacatgcagcaatgtatcatattgttatagaaataaaccatttgtcaccttattttccttattatttgtgattacaatgaacaactattacttaactgttttctcatctgcaataatatactaaatttggtatgaaatttacttgataactaggaggagagtagttctagattccatatttttggtacttcctttatgcatagaagtggaaagtagggtttctcattttaaggtatttaatatatttgtagaaagcctactctaggaatgccaagtaaccttttgaacttatacatgaataaaagatagagaagggcagagttcagaggttagggggctataggaacaaaaattttcatggcaaaggcaatggagaagggtcagaatgatgaatgaatgaacagacctgcaaacacttattgcaagggtacaatgtgccaaacactgtgctagataccttgacatatattagattatgtagtcattacacagattctgtgaaggaggctactattttactgattgagaagattgggctgagaaaaattttgttgacatcacacagaaattaaatttaaacttttggatttttaaaattttgtgatttgaataaaaacaagaagaaagcaaagttcagactgtttggagcatggtgaatacaacgaaaatttatcaaggacaaaagtgataaagttagaaaggccacttttttccctgattatagaagaccttgaattccttataagttgaataggaagaaggagttaaagatgacaaaaggaaaataacagggaaatctattttgaagtagagagtacaagttaggatttgatcatgcagagtttgagatgcttgttagaagcacaggggaattctctatcagggagtttcatgttaaaccctatataagatgagagaggtgaagactgaaaatgaagctttaagagtcatcatcatgaagtcacatctggatgaagagaggtcaccaagagagacagaatgggaactatggaggatgcctgttcttgtaaaaaaatgaatgaaaggggtcactgaaagacaccaaaaggagaagaccaaatggaaaagaagttggatgacccagaaagttcaggtttttcagaaggtaagaaaactttctgcacatgtatcccagaatttaaagtaaaataaataaaaacagaaataaaataaaatataaaaaagaaaactttatgtatgctaccattcagcagcattgagtacctcaaagaaagaaaggagtgaaaaaccaagaaaaagccatcgaatatagttaatggtggttattaaaagctttcatgggacatttcagttggagagaaagtgtgtcgagctgtgggggaatggaaaatagaattcagtatattttctcacagaccaatacaatgcaaattttgaaggaccctaatttgcttatcttaagtcttcaaaatatgatatttgtgaagaaagagactaagtttgttaatgaccttctaatagagaaggtgctcacctcttgttttttggaagtaaccagctcattgaatgacatgatgataaatttacgaccttggttgaacaaataactaataaaaaagattttcagtttgtaaaaatcttccttcatttgagaacaactaaatatagggaacaacagaagatttacaataaaaaataaagtagttgctatgtcacttccatgtcttgagacctcatcaagataaaattattgtttgctgtcaattttaagcattattttacatatgagattagtaatcactgttctagataattaacaaaattgtccttcataaattttgtttattctcatgcctcagctttctgagtagctgagattacagatgtgcaccaccatgcctggctaatttttgtatttttagtagagacagggtttcaccatgttggccaggcttatctcaaactcctgacctcaagtgatccacctaccttggcccccaaaagtgctggaattacaggtgtgggccaccatgcctagccacaagtccctatgactgttaaagggctttctctcaccgctggaacctgtttggtctataggcagagcaggcaagaaatgctggggagtaatgtctcctggagcagcccttacccaatgacaaatgtgagttggaggatgacaatcccaactttctcacccctcatgtggcataacactaagtcatgtattataccatttcccagaggcaccagcaggacagaatcacccacagtgcaaaccggaacattaacacacctttcattatcttttttaccttttctgtctcacttctccactgccttattgatgttttcagagctgaatcctctaaggagttgcactcaaatcttgatctcaggggctgcctctgagaagtccaacctaagacactggcattgtgtgagaacattaccatctttaaagaagatagatagatgagtagatagattgatcaactgcttgattgatcaatcgatagagtaaatccctacttcttctcactctaaatcatattatatagtattactcattcaaaaacagacaaacaaacaaatagcttggttggaaatcagttacttcagttcacaatacttcccctggtggttttcagttcaggtcttatacaaagaatcttagtatatatgggaggtttttcccagttggcagtcatagtagggtgtccttcaatgtcagcttcagattttctgaaaatgagatgatggctgagattttggaggtgctgcatggggcctctgaaatgaaatctggttagacatagtttgtattttagatcagcccatcccaaatatattctccaaatttggtgataaaccttacaacctttctcctcgaaggtttgggtaaactacaaaaactagttatatttataaagattatgtcataaccactgcgtcaaaatgttaacatacttatttctaggtggcaagattatgagtcaatcaaatattcttttcacacttgtgcaaacttttttacacggttaaagctgaagcaatgtagtgtagcttggactctagagacagactacatagattcaaatcttccactcagctacttattagctgtatgatattgagaaaattgcttatcacttctgtttcttatctgtgaaacagaaacaatgttacctatttcatagtattgttataaatattaaataagacataaatataaataatgcttaaaacaagacctgacattcaatacattgtcttttggctactatttttatttcattatcaagtaagggcaattaaaaatcaactagagtgctagaaaagatatttattctggttaattagcaaaattacccttgagaaaacaaatggccagtttgttatattttacccagaatgggatcttccccaaccctgcctctgcctatataaaaacattaaagggtgcacatatttaactgtctcttgattaacgtgcttttaactatttaatgtttatttaggttgccctaggatgtattaagactttttaaaaaaatttaactaatgggagaatgaaagctccccctcaaagtgacagaatggagaactcttagtggcactagcataatccttgggaggttggcatcggtggagtaggagactgaggcttagtctgatctttgtaatctgtgaaattcaattcaacgagaggttccacattgaaggaaaggaaagccagtgctgctcagctgggcactggctgaataagcaccattcccccgctcatgactctagccacttgctctgtcgttcccccacccctgtttggaacacgggggcaggtgcaagtagatgccaggaaagctgtggagtttgggccattatctagtaacgctagctctgccaggcagaaagaattttgtccctaagatgcgtagccaagagcagtgatgagaaacattttttattttttcggtttttaccataatagccaatttggggaaaataaaagtgtgaagggctgcaattttttatatcttgtgttcaggaaatgctgcacttgcaattacatttaagtattcatttattgtttctcattaccaaagggtttcactctttttgcctaaaatttcagaaactttataactacagtatctcattctaatgttttgccttaaaataaattttgtgtatgatgagacctgatggtgttatggggcagagactttgggagacttagaggtggtgtggccaaagggataatggtgaatctctagccaaatccaaactctgctgcctagtggatgggcaagacataaccccctaactggtagtgaattgtgcagtggaagcacgctgggcccataaccttattgggcctcagcttccttattataaaaaggcagtaataccagtaccttccttatagtgtggttgcaaccattcaattagataatatgagttagtcgtgtagtacagagtctggcacacattgaatattccctgagttgctatcattgttgttgttgttattattaaggaagtctagtgaaagaaattggcaccagaattcagctgtagaccaagtatgacagtcctgtttggaagtttctgcagtaaagagaggagctatcatttgtagggaatgtcttggggatcacagaaaatgatccaaatatgtgccatggctgctggcatgaaaagggttaaatgaaaaaagttagtgaatgacaaattagtctaccccatctccaccccactgttcccctctcaatctgtataattgcaagattggaaaacttttgttgcaacacttccccaaaaggagagtggtgatggtgaattgggtagaatggatattttagtttgagtttctgcaaaagcacatattgagaccaggatttgagtgcaagtagttttcttggaagacgatcctggaagcaccggtgaggaatggggacatgagacagggaagggaagaaagccaaaaagaagtagattaattggcaagataccaccattggcaactggggcacctaagatttttaggaaactgtgggcgacatgctccaacagtaaatccatccggcaagtgttcaggctggataattatacccccaatccaattggtcactggccaaaagctgctcctgggggtgttaattccctgggactgcatgcagacctagcatgtgcctacagctgaagaaagtcttcttgcaaattaatgaatgctgacattagaaagccatcattgtatacagaaatggtgagaacaagagagatacgggtgggcaaccaacagcttctaatacaataaggagacccttcaatcatttttcctagatctgtgaatgaccccattctgtataatttaattattcttattaattttttattaagcacctgcagtgtataaggctctgaattatataggcacttggtatgtatttgttggtgaagtagacacgactgcttccctcacaaaatttacaattagttggagacgggagaaagacaaagaagtgagaaatataaataaatacatatatatgcatatatgcatgtacatatttttacagttgtaatttctatgaagaaaatgaatattgtgcagagaagtaaaataagaattagtgggagtggagaggatcaaataatacatactcagaatgaacatcgcttagaatgttctaagcaaagagaaaagcatgggcatggcctttagagagaaaagactggaatctgggggaataaagagaggctcctaagtggagcggggagtgacatgagacaccaaagaggcagggatgcaatcccagtaggtatcaggtaatggtaaaagtcttgagaggaaattaggaaggttaagggataaagagagaagctgtactattttagatcagctggttgggggaaaaccttgctggtgaaatgaaatttgagtgcagacctgaaagaattaggagagggagagcctcaaagatgtctgaggggtatattccagggagagcaaaggacaagagcagaggcctgaaatctgagattggggagagtctgagaaccagcaaagaaaccagttttgctggattggaatgaggaagaggagagctgcaggagatgaagctgaaaaaggaggcagaggctggatcctgtagggtgctgtgggttcataggaggaaactggatttgatgttgagtgaaatgggaaggcattggaaaggagccatacaatttgtttgtaaaagatcttgcttgtggctaatgaaagtaaattcacttaaggggtgaagtcaagaaggtcagtaaggaggtggctgcagccgtccaaggaaaagatggtggtgggttggcccagggtggaggcagcagagagggaaggcatggtatatagcatgccatgcgtggtcttccatgccccacttccaatggtgcatctatagtccagtcctgttcattagtttttccatcacttttctcagtgatgttgagtagtgttggacagtctagggaccaactttaatattttaagtttcttgttcctgattttggttcatgggcaccccttggacccactaggttttttgttttttgggttgttttgttttgtttgagatggagtctcactctgttacccaggctggagagcagtggtgcaatctcagctcactgcaacctctgcctccctagttaaagtgattctccatgcctcagcctcccaagtagctgagattacaggcagccaccatcacactaagctaatttttgtatttttagtagagatggggtttcaccatgttggcaaggctggtcttgaactcctgacctcaggtgatctgcccacctcagccttccaaagtgagggggttacaggtggagccactagatttccatcaccgtgtcagcagtcaaaacacaagaagacaaccagcggatttgacttgaatgatgaatctacacaattccattgagatgtgtttgggaacatatttctgaagaccagaaagcaataagaaatttatgaagtagataataatcccactacatggaatatgattttaaacaagtcattgcccaaatcggtaggggtccattcaggaaacaagagctcatgccaggtggttcaattacaaaaagttaatgtagacaattagctacacagggtttggatgatttggaaagggtccttaaggcaatctgaagacgagcaagggagggaagacacccctaagggtagagcaaggattgacaaagaaaatctgttgagtagaactggctggccccctacctgtttgtatatggcccacaggtgaagaatggcttttacacttttaaaggtttatgtgtatatgcatatatataatttttttttgagacagtcttgctctgtcacccaggctggagggcaatggtgcaatctggacttactgcaatctccacctcctgggttcaagtgattctcgtgcctcagcctcccgagtagttgggagtacaggcacacaccaccatgcccggctaatttttgtatttttactagagacgtggtttcaccatgttggccatgctgttctcgaactcctgatctcaagtgatctgcctccctcggcctcccgaagtactgggattacaggcatgaaccaccatgcccggcctaaatgtgtatgatttaaatgctacataagtacttacaaaatactatcctcaattttgccttttgactcataaagcctaaagtgtttactctcttgcccttttttgtttttttcaaaaatgtattgactcctaggcaagaggcacgataagaggaagtggtcttgttagagcccaaggtggaacctgtctatcagaagctgagaatatggtgagaggaggcgtctagtgagttcaggaaccaaggaagagatgcagctactatgaaagatgttcaccaaagcaacaagagaaaggagtgaaatcccctagattttcccttgctctaaccctccagtctcccaccagagcttcctaatggctgaatgtaactggaagccagttggacaggatcaggcccctgactgagatccagagcacaggaggagtagggcatgggatcagaacaaccagatgatgactaccacagaaacccttgctgaacctcagtttcctacaaaatgagaaagctggatttaaggcttcctaagagagagttagacctctaattctacgaaaatacagaggaacagtagaacttgaccttggccaggaacctggtagtgccccagccactgctgctccagggagaacagagggaaatgtaaagactcaaagcattaatttatataagactctttgaacctcgtagggcttgctctgaagcttgttctatttaggtaagatctgaacagtcttttaaagaccaggattggggcacttactgaaaatgattgtaggttatgtaatcaaggctgttgtttctgttgagctcccatagggaagtgacaagcggcagagattaaatcattgtatgctgagtgggccttttatgtagttctcagtctcactgtgtgtaattttacagagcaggcatgggggagtgtggtgggaagaacctcattaccagggagaagctttacaccctagaagaacacaaacattactgttttcaaagttataaaaataagttctagttttttccttacatctgttttctttcctagaataggaaagagaaatagagagactgactttgagttgcctagaaaaggacaaaaaaatccagctgtagtgacagcctcggaatggcagaaggaaacagcccactcttatctgtatgttatgtcatgtgccttgaaaatgtgtggtgcctgcaccatggtcccattaaccaccctctctgcttccttctattcctgaaagaaagaaatgttaggacatgctttgcgtcccctcaagcaggtggctggaagtcccacggtataccttatggggtcaagctggtgtcaactgagtggtggagacctgtgttccctctccttccccaaccccagcccatccccaatagaatggcattttgtgagccatgagaggacttagattctccagggctgagaggttcaaacagagaggattggcaagtattcaaactgactcgctagtcagatactctggcagccagagccgagacatgaaaccatcagggcttggagtgtcatgaagtgacaactggaaaaccaggattcacattcttaattccccttccagtatcccactgtgggaattcagagaccctggatgtgatcagaactttagactctctcaatgataggttgaaagctcccctacctgcatggtaacgtgtagaaagctcatttaaaatggagattccagccaggcacggtacactgcttgctgtaatccaagcactttgggaggcagaagcaggtggatcacttgaggtcaggatttcaagactagcctggccaacatggtgaaacctcatctctactgaaaatacaaaaattagccaggcatggtggcgcacacctgtagtcccagctacttgggaggctgaggcaggagaatcacttgaacccagaaggcggaggttgcagtgagccaagatcacaccactgcactccagcctgggtaacagtgcaagactctgtctcaaaaaaaaaaaaaaaaaaaaaatggagattccaagaccctaccccagagacacatttaatcagtatctgggtgaagcccaaggattggcatcttaaataatccccaagtaagccttagacttgtggaaattggagaactgctgacctaaaaagaatcagacagagctttgatttccaatagactgatatgttgtgttttaacattgattgattttttttttaaatttgggattacactttgatttcagcaaacaattaccttatttattatacttaacacaataaaaaatttttaggtaccataaaaaacaaatggatgtttttattttttgttattttcaaattttctattatgacatacattactcttagaaagaaaaacaaaaaacttgaaaagaaagcaaatggtaatttaaatgtggtagtaataggtgaacagtagcactttcacacccccgccaacaatgtgcttttgagcatgtccccttaaaaaaggctgaagtgctagttgccttctccacctcagccaaatacaaatgaaggtagagatcaaaaagtagggtggatatgttaattcttatatatatatatatatatatatacgtatatatatatatacgtatatatatatacacatatatatacatatatacacatatatacatatatatacatatatatacatatatacatatatacatatatacatatatatatatggcaaagatcatcatcatcatcgttgtcatcgatatcattattatcatcaaaaaaggccactattgataagtttaccatataccaggacagtggaaatcacataacacatattatacccatcagcgctaacaacacctctatgagatagctactctaaactccacttgacaggtgagcaaactatggctcactgagattgaatgccttgccctaggtcacatagctagtaagtggcaaggccatacttagaatgtctggatctgactcacatcaaagaccatgcccttcaccaccatactgtaaagagcagcaatgatgcccttgagttgacaagtccccacaattgcagagacttcctcctcattcctacatttatagcctattcctcataccagccaaaccaggaaggtcaagaggaatttagcaaatggttctcagagatattgttttccttgggactcagaatcactggcattaattttccagttgatttcctgagtccaggaataaactgtgaaggaagaacaactctaggctggaactgaaatgattgttctttttcctttttgcagctggctagaatttgaaataaataagttgttgctgacacagtttgtagaatttctcatttttcattttgaaagattctttgccaaactagcagctgtcacttagagactgttaaggagtcacacaaatgacagggttttctaagaataaagctattccaaagggtttaatgctatagctgattctcctttccctgacaaggggtggattgtggagggaagaaggagatgagctgaggggtcccagatactaatcaaaaaacctgaacatctttgattgcaatgaaggatctttagttatcatctctttaggcttaatgctgtgatataagaagtaagtgtaaagtgcagagaatcacttttcctaagtacagagctggggcttcttccaaggtatgcttgattaccttttggcatctttagaaattagctatgaattatgctcaacaatctctgtacacgtgttttattttagtacatgcaccagggggttcactttccactattcttccaccgtcttgcattctgttgtttaagttaaattttctgttgtttataaccacattttaaaatatccttttttattagaaaaagtagcactttttttggtttttttctgttctaaaatccttttagcaaaactatggagacagtaaaaagatcagtggtggccaaaggttgagggagatgtggggtgtggaaggaatgaataattggagcacaggatttttttaaggcagtgaaactactctgtataatactataatgatggatacatgtccttataaatttctccaagcccacagaatgtacagcatcaagagtgagcccagatatgaactgtggactttggataacggtatgtcactatatgttgattaattgcaacagatgtacctcctttgtgcagaatgtcaataacaggggagactgtgcctggggaggagaggggttatatgggaactctttgtattttcctcccaatttttctgtgagcctaaaactgatatttaaaaaaaagtatttattttttaaaaatcctattatatagaaatgaattagaatattaaaatccttcttaatgtaacttctcagagataatctccacaaaagttttgatgtacgttatttcagaacttttctttttatgcattcatttttataattttgatgtaaatattattttacaagtcatttttattaaaaagaataattataaatatattttcatgtcaacccttatgtctctaccacctgttttttggacctcatagctatactataatttcttgtatgactatatcatagtttatgatgccagttacctatgtggacagttaggttattttggtttttcactatcacaaacaatggtacaattaaaataattttgtaagctcatctgtcaggtaagtccctgggccaaaaggtgtacacaccttaaatttttatagattttgccaaattcctctccaaaagacaatttatatgcctatcaggaagatatgaaagtgcctgtttctccattcttcctaatatggaatactacaaatgcatttacttaattactttagtgagaattaatacttttttacataattattaggcatctgtattcctggccaaaaaaaatttaagaagaatatgctcacatttctttatatctaatcactggcatacccaccttatctcttgcccacctgcccccagttgttttatgtcaatattcctcaatgcatacctttgatttactaactgatgcaactcactttcagtatggtaccaggcactatgcttggcaatgaagggaatttaaaaatgaaaagggaatgggctctttttttatggagcttcatcctttttaagaatagcttgatattgatcaagttaaggcacagagaaattccatggctcatccatcacccactgcaagtcctcggttgtacaggagtttgcataaatattcctgaaatccttacccaatatgaccatcacacagagtcacactgcagataattagaattaaggtctcttaatctttactaatgacaaagaagtctatgacaaatcacccaaattaacaaattaatatttacacagtgtgagcgaacattttgaaaatttgtatattgaattaatttacatcatggtgctcatcttaacaaccctcattaaatgttggcattgagaagagtttgtttcatagtacttacaaagaaaactcattttctagtccctgtttcctcacagatacaacgtatggtgaaagagtttgtcttcaggtttaattttaaacaatttattcttatttatctctagatttagtttatgtcttgctaaaatgagaagggacttgttccttcaatattcttctaagtcatcacaattgtcaagagagagtaaatgccatggataatatgccattatatatgttgtggggtgttgctgtttttttttttttcttgtcagtgtgaaccaccatctttgacacaaactttgccatttccaaatctgaaattactactctgattaccatggtctttagagatggaattcagtcgctctgcagagtgaatattctttaaagactgataaagcttagtgtttcctttatacagatttttaaaaagtaaagcataaatattccgtatgggaacaaacagtggcacagaagaaaatgaatgtaaattccttatgttgtgcaagactaaatgaaaatgtaatgtgaattcctccctaactcaggctcatcactggtgccagatgactatgtgtttctgtagttttaaaaatcacttcaattttcaaccaaatgctgctagccagataaacagtgtgtctctggtgctttttataatgctttttagaagagaaatacagggagtaagaaaaaaaagtacactcagctcttctttcaaagtctcactgtacatcagcagaaatactcagagacgtgttgaacttttgagccctcgttcattcactcatttggtcagtccatctgtgtcaagtgtgtaaccagatgaggatagggtgcttgccctcagcaacagaactagtccatctttagctatgtttgcgatctaagggcaccaccatcttagctaattggatgggaggtgggcactaatttatcagccagtcaataatttataaatggttcctggcaaaaagactcgttcattcatagagcacattttttgaatgcctgcactgtgccaggagctgttcttggtgccgggaatccagtggagagcaagattgattggggccttctcatggagcttcatgttgtagtgggaggaaggaagggagaaaataaacaagcaaacgagcaagagaccaagactgtgtcagattaaaataggtaccatgacaaaaattaaacagagtgatgtgatgaataattggggaaacgttggcaaagagatcccttttatgaggagacattgagcagagacctgaatagcaagaaagatgaacgattgcaaagatctggagaagagattcttacagatggaacagcaggagcaaaggcgggaagaggcctggtgtggtaaaggaatagaaggaagactagtgtggcgagaccacagtgcgtaagtgcagagtgtgatgcagtgaggcggggaggagccagtatcagacatggcctcgtgggcccgataaggcgtgtgaatttttttctagatgaaaggggcatcttttacttacaactacagaagtaggccagccatggtggctcacacctgtaatctgagcactttgggaggctgaagcaggaggatcgcttgtgcccagcagttcaagaccagcccgggcaacatagtgggacctcacctctaaaaaaaaaaaaaaagaataaaaaattaaaaaaaaaaaactacacaagtgccatgatctgatttacatattttaataattattttagctgctatgtgaaaaaaaattttttctggtgcagtgaggagaccagttaaatggtggttacagataatctaggcaacagttgatggtggcttaattcaggttttagtggttcagagagagaaaactggaataatttaggatatatgtaaaggtataatccatagaactggctaatagaaagcatatatgggcgagaaggttaggcaaagaaggaatgaagttttggggtccaagaactggaaggatgatggtgggaggttggtgggatatcagttggttgttctattttggacatgtaaatctgtgatatttattagatgcaatagtttttttcttaataaatgaggaaatgacctgttgtagaaagctgcaccagaccaactcgatttcttatttggggaatttgcaccaagaagctagagagagtaggaacaaaggagggatagagtttcacatcattgatgaggtacagtcaagaccaaagaggcaatgaagaactctatataagccaaaattataaggaagcagaaaactctgaatcaagaaggaggccacttccttcagaggtgaaggaaagtatcagaggaacaaagacaccttgagaaaccagcaggatgcatgtcctgtgacagagacgggaggtgagttaatcctagagctgcctctgtatttcttactttctagctccgttcatatgtatccttccaaaaataccctcatttcttgatgtaacctaaatgggtctctgtttctttctaatacactaacctatttgaaataaatacacaggcacactgaggaccaccaagattagtatgacaaattcattgtcctcaaggaattcacagttcagtgaagaagaaaagataatcacacacacacacacaaaaactgttttgtaaagtcaaaatggaaggctaaaggtgttaaaacactatttatttgccattgggattaaatttttttaaaattaaacaaaaaatatgcaacttgctcactggaatctgcattaagtaatagaaagtgtgacaatttctagcaggaaatagatggtattaaataagacaagggtttcccagtttggagcatggtttttacccatacctgcataccacctggactatttacttaatattttcgtttgagtaaaaactcacttttgtaattgaaatgcacactttaccccatcctaaacgataatacccttgaaacaatgtgaaaataaagagcagtcctctatgcctccgcagtcatctcaatcatcaaggctacatgtactagattcttggaaacactgtcctagagaaaaaagagctgaatccagggttacgagatctgactttggacttgcctccctcaccgagcaattgtgggattctgggtgagtcagtctgtttttatctccgcaataaaatgagtacaatatcagccctgcccaccttacaaggtgattacagatcaaacaaaccaaagtgtgtcaaaatggttgaaaaaagaaaaagtactgaatatatgacagtgcttattatggatgtagatgtggactgtaatgatcatacagtggcttcctaaaatgagtgtcccttgggaaaatgctggcattttaaaaccaaaaagaatggtttctcctctaagctatgttcccaggatgttccagctcttatcttctcaaaacttgttttcactcacacaatttgatcactgctcattcactgcttttgtggtatttccaattatttctagcaagcaagcctcatcttcccaaatatattaaaaagtccccagagaactcattcaaatgagttaacaattataaaataaactatacattatagtacatagtgtggtatagacaaggatttagtgctatttatgggctgagtctttgtacaagttattaatctctctgaacctattttctaatttggaaaatgaaactaataatccctattttgcaagttttctgtgacattgaatgaaataatgatagttaattgcttaatacagtgcctggcccatggcaaattgtaaaaaaaaatagccattattattgcaagagtgatgagcattattattcgcactggtgacataccagtattaggggtctagaattctaaatgtcattatactcacctcatagggttattatgaaaattaaatgaggctgggagtggtggctcacgcctgtaatctcagcacttttggaggttgaggtgggcagattgcttgatctcagaagttggagacctgcctgggcaacatggtgaaacctcgtctttacaaaaaatacaagaattatctgagaatggtggcatgcccctgtagtcccagctacttgctgggctgagatgggaggatcacttgcacctgggaggttaatgctgcagtaagctgagtttctgttagtgctctccagcctaggtgacaaagagctactctgtcccccaccctcccccaaccaaaaaaaaaaaaaaaaaaaagaaaagaaaaagaaaaaataatagaatagaaaagaaaagaaaatgaaagtaatcacatgtaaacacggtctggcacatgataagtgcttaataaatatgatgagcctttgctatcatcatcagcttttgttatctccgtgtctactattgtaagtcttacttggataaagtaggatatgatgactttaagaattttgagttgtagaaaattctgtatctaatcataattgactacattgttatctattttttgaaatactctaagaatttaacacaatgttagaaagtaatagatacctaaaagatactacatgatgaacaggagagattagcctatggtttgatttgaacaagtaaaacttcttattgataaagagctagacctgtgctattatacactagctacatgcacttgaaacgtggctggtctgaatggaggtatgctgtaagtgtaaaatacacattacatttcaaagacttagtatgaagaaaataatatttaagtctcattaataattatttatattgattacacatagatgcaagtgatattttcgatatattggtttatatagacatgttatcaaaatttatttcacctgtttctttttatttttttaatgtagctaccagaaaatttaaaattgcacatatagttcccattagtggcttgcattctagttctgttgggcagtgctgatctaggacttttttagacttcattttttagaggaattttaggctcacagcaaaatggagaggaaagtacagagatttctcataatcccccttccccgccacatgcataccttccccctttatcaatatcccccaccagagtagtgcatttgttaaaactgatgaacctacactgacacatcattatcatccaaagtccacagtttacctcagggttcactcttgttgttgtatgttctacgggtttgagtaaatgtacaatgacatataatcaccactatagtactatatggagtattttcactgctctgaaaatccactgtgatctgcttattcaccaccctcaccacctccaacctctgacaaccattgatgctttttctgtctccatagttttgctttttccagaatggcatatagttgaagtcatacagtatgtagctctttcagattggcttatttcacttagtaatatgcatttaagttttctccatgtcttttcttagcttggtagctcctttctttttagcacttaataatattccattggatgtagctcctttctttttagcacttaataatattccattggatgtagctcctttctttttagcacttaataatattccattgcatgtactgcagtttatcccttcacctacaaaaggacatctaagttgcttccgagtctctaggattatgaatgaagctactataaacatctctatgcagattttcatgtggacataaggttttaattcctttgggtagatactaaggaatggaattactgggtcacatggtaagagtatgtttagtttgtgtaagaaatcaccaaattgctttccaaagtagctgagccattttgcattcccaccagaaataaacatttggtgctatcagtgttctggatttttgccattataatattaagaggtatgtaattgtatctcattcttttaatttgtattttttttctgatgacacgtgatgtggaacatcttttcatatatttatttgccctctgcatatcttctttggtgaggtgtctgttaaggtctttggcccattttttaatcagaatgtttccttattgttgaggtttagaagttttttgtgtatcctggataacagtcctttatgaaatgtatcttttgcaaatattttctccaagtctatggcttgtcttcttcattctctttataatctaggccattgaagagttcaagtgctggcaaaatattgtggcacgtcttataattgtacaatatcaaaatggcctttttgaacagaaaacagtagcaaaattcttctcagacttttaatctcaactcttttttactgttttttgtttgttaaagctattttctccaattattgttttgtagaaagtcacagttttaaggaggtagggtttagtcatctattccagttttgtcatttgtttacatctcattttatttaaaatgtatttttttctaacaaaacatttaagggttgtttctactggattaaaaagtatagaagagtaacagtacctcctaaaactaacaaactaacaaaataccaaatacacaacaaataatgttagaattatatgtataatcttaaaggacagtcagtggctaaggtgatgagtctgaaaaaaatgaattatttagatatcaataatattttaattaatttatatgaataggatattgcctttagtaatgccatttatacccagcattaacagattatagaagattaccatttcctacttagtattccatattaatttgtgaatctagtggatttttattgaaaaccttacgttattttcatacgcacatttccaaatctttagcaagtactatatataacaggataaccttttaatgagttattttatattaattgttgaaattaaaatattttaccaaagaatatgctgataatgttttaaattatcatatacatctatgcatccacatgtaggtctgactgttcagacttttgggaatattataaaattaggagccctggtaagctaagagtcaacacgaactgctttacttcatgaagatcttgcaaagaaaatctcaacaactgtctgaagctcgcaaaataattttttataaagagatattaagtaccaacttgctttagcttagaactggtgattcacagaatagaagaaataaaatgttctttctgtaatctactcacctccatcttccttcttcactctgcaggtttgtaacaatccaccctcctccaaatttacaaaccatttgcttttccaaagtttatctacaagtcagtcattgccccttcgagtgcaatgtgtattacgttccaaggctagcccaccaaacctccgtatattgctaaaatgctatgcatttacactgaacaacccagatgcaacataattaatgaaaagagattgccacaaaattaaatattattttaaaatatgtcttgatctatgcttgaaaaaaggcagtttttaattagcaaatgaagagaaaatgggagagacttctgtggccattctgaaagttggtttgggaactttcaaagactatcgaggttaatggcaaagattctgtatagcatctagtagaatttccaaatgtcagacttattacccttaaatgcattagccacggtagggtcctgtgtgactcacgtggacagagggatgtaggggaagtgataaaaagagagcaaatcagagtagagagatttctgagatgactgagaaagaggtgaaagtcagaaaagggaggtgaatcaagagtgtgtctgtgagtgaaagatggtaagtgaactggaaacagaaggaagaaaagagaatgtatggagcatactgtcagtgatcagtgttaacagctctcatttactgagctcccacactgggccagcactgtgccaagcgctttagacacatgtaattttcacaatgaaagtctcacttataaatgacaaaaccaaggcccagaaggttaaatgttaggttgaagcatatgaaattgacacatttatagatcaaaaccaggtgaatatcgacaattttatgtgaaaagacctcaacttaacaccttaccgaaggccacagggctagtaaattttggaatgaggttttaaatgcctcaaatacctggctccaaaacactagttatttcccctacttttcacacttccacacaacaatactggtgagaagtaaaaatatcttacgggagaagcttgagtcagacaagccctcattctggccatgaaaatggtcccatcaaagaaggaatgctttttggagccaagtggagggtagggaacagagtagaactaattatttgaatgtatgggttatttgtgggtctgcttttgcagcttgaaggttgtctacagtaaatagtttatatgtattaaaaagttaattgataaagtgaagaccattcctgcaacagcatgcttacattgcaatgtgtttatatacaagataaatattttattcctttcaccctaagaaagcagggttttattggttatcaacagctaacatctttatgcaaattattccattggaactggctgtgattttcattccaattggctgcatggtttagtcaacaatattctaacagctagatgagttcaatcaatgacattaatgccttatgaagggccttctttgccaacccttttattgatttttgtatttttatgtcctctaagatttcctcattgggctgaaacctctacccgccgataaatagctctgtctgttgttctggacttatttcatttttttctgagtattaaggcagcacctagattactcctccacactttgttgtcactcaaacttagatgctcctcccttccttccttccttccttttctccttgcttttttccttctctctctcccttcctctcttcccttttcctccgctctcttcttctttcctttctttccttctcctgacttagccttacagagcaaatttgcaatatgaaccattgattgaacatgggccccaatgccatgattggacagtgggaaaggcctaaggtgactgatggagtacatatgcttctttccaaatctgcactttctacttctcagttaatgatacccaaaaagctaatagttattaattgtatgccacaaaattttcctaatggattttctcatttattttgagaaagcttattttgtctcctccaggtgaatgagttaggccagtgatccccaaagtgatttttcagaactattaatcctgtgaaatgctcttcaaagaaaggatttaaatgctgttgagaaacaccatttactggccccctttatgatgtacgttgaaattgtaaatgctctgagaagtcctacagtagaaaaatctgtttatttttgttcatctggcatttcccaaactcatttgatcatagaaacttttcttaaagtgttaagatcttttaacgtcacacaattagtttttcatatggcatactttgggaaatgcggagttagacattaacaaattttctcattttaactgcaaaagaggaggtataatcttaaaaggatcattttaaattaaaagttaaaaacctccatgctgcctctgaaacatatgacggcccctgagcactgggctatgagaaccttggctttatatgtgatgagttgataccaaatagactgcagactcaaacaccaatagtgccatgcaagtagcataaatgatgaagaagacaggatataaaacaccacagtgcaaaaggaatgaatagacagacccactgctactcagccctatgaagaactagcctcagaaatgatggccgaggtgggagaatcacttgaacctgggaggcggagattgcagtcagccgacatcgcaccatggcactccagcctgggtgacagagcgagactctgtctcaaaaaataaaaaaaaaaaagaaaagaaaaagaaattgggctctttaccaacagatgctctaagcggtgcataaaaagtttaaggagaaactggatattttaaccatatctgccccaaatgtttataaattacaaaaggaaaaataatatgtaattggtatgatgcactgaggtcacaaaattgcttctgtagtctttttgtcacaagtgcataacctcaatctaataatgggaaaaaaaatcagacaaatcatattgagagatattctgtgaagtaacagacaatctgtgaagtactcatatgttccgagaagtaacgtgtaagtaacattctgtgaagtgtttatcagaagtgccacagtcataaaagactgggggaaattagggactgtcacagattgatggaaactaaggaaacacaacaactatgcaactacatattattttataaaagcggtgtaggatcctggatcagattctggaatggagaaaggacattattaggaaatgcagcgaaacttgaataaagtctgtagttcagttaaaaatattgtgggacatttaatcaggggaaactagaggaagagtatatatcacctccgtgatttttgcaaaattttgtttaacattagttcaaaataaaaagttaaaaaatgatagcagaaaaacaaagaaaagaaaaaaaatgatgggattcaggaactccaacacaacactgacctatagaaacatagtacaagccatggatataagtcacaggtataattttaagttatctagtagctaacttacaggaaatgaaaatggcaaaattagttttagtaatatattttgtttaacctgatatatccaaagtattaagatgttaacattgtaatcaatataaaaatgttaatgatatcgtcaacattcttttgtactgtcttcaaaatccagattcaattcagacttttcaaattctcaatagccacatgtggctagtggctactctttcgaatagcatagctccaccactatcaactctatacatcttctatttctgcttccttctgtgaggattttgttctttcttgctgtagactcacccttccttccttcattcattcacctacaagaatttatatattccaggtattgctctatgcacaaaactgacaataattcctaactttctggagctctcattctcaagaggaagtgattgacataaacagtggctatagtaaataagtaaattatagtaagaagtgataagtgccaggggagtaaaaacagagctgactcagatgtcaggtgactcaggtgatgtaaggtgactctggtgatgtaaagtgactcagatatgctgggggtggaattgcaacctcaaataatgtgatgtcattgagaagctgacattggagcaaagaccaatgtggaaagacaaaactccctaactcaaccatcagagcagaaagtgacttcctcctggcttcagttagacgaatcccaggaaagtaatatgactggcctggttagggtcatgttacctctttgtgaccaatcacatggcctgaagggtggaacataaccattctgattggtccaacctgaaccactaatcaaaaaagtacaaattaaaggatggcagctaccagttgcagaaacaatcccacccaccctcttcatcccttagaaagggaaagctattcccagaagaaaagaaggtactaggcaggaagaaaaatattcattcactaagtttttggaatttcaaaagaaccttgtctctagtcttctgtgacttcctagacaaagtccatgtttaccctgtcaatttgcttcataactttatagacttttaacaaataggaaagtaaatggaaagaacataaaacttctggctatgtggtcctagtttaaagtcccagttcttccaagatcagctgtatttccttaatactcatgtacctttcagcatatatatatatatatacacacacacacacatatatgtatgggtatatctatatacacacacagacacacacaattaaggctgaaagttatatatatatgtatgtgtatatacatatgtatgggtatatctatatacacacacatacacacacaattaaggctgaaagttatatatatgtgtgtgtatatatatatacacacacatatatataactgaaagaatatacatattcttatatatatacacacatgtatataactaaaagaatatacatattcttatagcctgaaaaacatctcatatctaaaaataaatcttttctaaggaagttctaatatctcttaaaataagtgtggctgcccttttcttgttctttttaccagtttctttgcacattccttgcttttgcccataaagatatacagcgtacacacattgatttggagttgctaactaaggctattttcctctggggagttaaaaatagaatacacctcagaagaacctcaacgtctttagttatactaaagaaaaattgtcagttcattcagaaatgctaataaaaactaatactaattaagttccaactaaattgatagtccccagaaagataattatttttgacagacaataaaggttattatattttgaaaactgtacagcataatctgaagcaaaaaacttagcatggtatcttgaaatcatcttttctagaaagttttttgttaaaattaagcatttttaaaatgacatacattataacgcagttttcacatggactatctcatttaattattactagtatgcgagatagaattctttcttctctccttcccctcctttctttcttctttgcttcctttttttcctttcttcctccttcctttctcatgactactaaccagaaaatatcattctagccattatagacacagcggtactatttggaggcttatatttaagagtggggttgatggtgagtatgtggcagtagaaggcaaggaacaaaaataaataaggggggaacaaaaattaccttaatttgaaaggattatgtgatagagtggctgagctgggagccttccaactagcaaagcagatattcacaaggtaaggttgttaaaagaagcagaacattcaaacccaggtcaccctatcactgtataatgattctttccaccctttagtttcaacagatggttttgaatggagagaacaatggaaaatttaaaacaatgctgtgtttttacttgtttgatacttaacaggctcaagtccagctgagccatagatgactgaacttgactgccattttcaatgtgtggtttaaaggaggtgacagcattctgaaccaacagtccttcacataaataaagcagaaatatgaacgtgccagttgtgggaacaaggacatctcagtagaaaagagagggttcctaaatcatgcaacccactgcaattttttgacatgaggccataaaggttaaatcaataaagttagattcttactttcccggagatttgaataattatttataccctggtgagtttaacatattaaaaaattgattacctctctctcaaggcgtgtgaattttgtttactctccttgtaatagagtatggggttttttgtgtgttttttaaacctgtgatcagtaacagttactcatttaaatacctcccagtctcagttctttatgctctgggatacaagaaaagaatggagactggaaatatgtaagtatccaagacttctgcttttcagggcctgagaaactttaagtaaatgaaaaggcaaaaggtacaactgtgtgtgtgtgtgtgtgtgcgcgcacgttgtgtgtgtgtgtttcatttgttctgcaaatgtggtctcctgcatctgattatgtgggatgcttgttgaaatgcaaattgctggactcagccccaggcctcctgattctgaatttttggtaggtgaagcctaaaaatctgggtagttaataaggttattgagtgatacttatgctttttgggtattgggaatcatggaccctgagtactgggaatcatgggcctagaaaggcctgaatgaaaatcctgatgctcctgctcacgggctggggtgctcagaggttctcatctaagaaagtgaccctgagatgctccctccaagtaggtagtttctctgtttaacattccttgtaagaaagaggaggagttcatatccagcatagtttgccccactgtgccaagtccagcagaattcttcagagctctgcattgtgacattttaacaaaccattctgttcacatgttttaatacagttggagtcgaggctgcttttgtgtccttgttttgcaaaagggaacacaggcatttgtttctacttcttttcttttaacttggatccctataatgcacgtatttataatccaagaaggcaagaaagagaactaggacgagcttgtgcttttaaggcttgccatgtggacctggaccggaagacatcaggcctacaaaggcgagccagtaagttctttgtctctctgagcatgggccttttatcatatatggccccatctgagtagcttttcttaacggataaattatgttttcagggcctaagaagaaacttataattattggctctcaagtggactcgtgcactacttaaaagcaccaaaagaaagagaaacttatgaggtttctgctgctttaattagaccttggagccctgaaggagcttactttttatgctgtagtctcttctcttttcttcattttaaagattataaaagtaacatatgcttattgtaaaatattcaaagaatacagatgtatttactcaaaaatgaagttaccccataccagccaccctaattttattcctgctattctttctagatttttctagacatatacgaacatatctgattactgacacagacacacatacacaagcgagtaattaggactctttgaattgtaaatgagataaacacaattcaaaattttataaacaaatgggaagaatctctttgcttacataataattctgaagtgaggtatactaccttcaagaatggctggatacacaggtcccaacagggtagtttctctctctcgtctcatgttatcttttggcactgcctctttctgtgtgtctgcctcattttcccaacctcagtgggctttctcaatggattatgctatttgcagccctgggtttactctagatttggaacagaatatgtaatatcctcttgacaacaacaacaacaaaaatacacatcctaatccctaaaatctataaatatgttacctgacatggcaaaagagaattaaagttgcagatggaattatggctgttaatcagctgaccattaaatagagctgttatcctgcattatctgggtgagctcaaagtaatcacaaaggtccttaaaagtgaaagagggaaagtagaagagttagagtcagagaaagatgtggtgatggaaacaaggtcatagaaatgtgacatgagaggattcaagtggttgtggctgaattcaaagctggaggaaggggccagaggccatgaaatgtgggtggcctctggaagctgcaaaaggcaagaaaatggattctcgtcagaggctcaagaagaaaacacagccctgcttgacacctgtgtcctatttctgacctgtgaaaatatagcatagtaaatgtatgcttttttaagccactaagtttgtgctaatttgttcaagcagccacagaaaactaatacggggttcaaaaggcaaagaattgttctcttgaaaatctaaattttaaaagtccttggaaagcttcttggttagttttcaacccagcctctattttagtcctatggttagcacaataggataccacaaatgtctagatctgaatactgcttactgcaggcaagggggattaagagactgagggccagtcttcctccccagaatcgtataactggcctgggaaaggagaaatacaccaaagaaaaagatcatgagggggcagataaaaattctccacatatccccccctcccccccacccccacactcctacacataaggagaatttgttgtccatttgtttctgtttttttgtttgtttgttttattgaggtgaaatctcactgtgttgcccaggctggtcttgaactaggctgagggattctcccacctcagcctcctgagtagctaggattacagacatgtgccattgctcccatcttgtttgttttaaaatgaatttgtaacttatattttgttctgtgacttgcttaatcctctttaaaatgtattttaaagatatttacatatcaattcacgtagatcccactttgtcctttttaatagctgcatggtattataggatagatgaaccaaatgtatttagccaagtcccctgttgatggaagtttaagttgtttccaatatttgcttacagagaagtctgtgtccttcaatatatcacttcacatgctgtaacctttattatttattgttcaacataggtaatttgagggagaatagagccaaaactggtatagtgggttgaattgtgcctcccaaaagatatattcccctacagtgatcacagcatcaaagaacttgagtggttttgcataagagaactgagtaaataatcaaatgaatgtacaaatgatggaaggaatgaggagaggaagatggaaggaaagaggggagaaaaagaaagggagagagaaaagaaaaagtagactattatgacaactgaggagcctttgaaatcccaggagggcatcttgctaaaatgaagccctttatatttaattcataaaccttctggaagtgcccataatttgcctggcattgactgcagtgacacaagccgatcttcttcccatgctcaccacccccaccactgctgcttcaagtcaaatgttagaaatgcagtgagcaatatccaaagtagagagctaggagtctgattctttgattcttttagatcagtaaagcactaaaaaaattcaataaggcatgtaggtataatcaaagcacacaaatgtgtttggtgcattagactttttctcatatggccttttacatgtgcaagtcaccattgggccagacagttcatacttggtcattggcagctgtatttacattgtaggcttgaatgttttttgggaaaaaaaagcaggtgttgagatgcttgtcttcagggtgagtaacgtgccattgcacatctttacacctgctgaagaagacagagcaagtcatggaacatcatggaaaatggaacaactcattgaaatctctgcctgttgtccctgctggatcatagcatagatcccatctctggcttttggctcttcagcagttggctcccaccatttgctttcctgggtttctctcccgtcatctaggcagataaacagcttgtctcttcatccttcaaggccttctctctttctaccctaggaagaacatatgactagggaacatgtgactgatcttattaaattagaatcactaatatatattgtagaatgaggccatttggagtaagtaataaagtgaagaaacagaccaatattaacaagaatcagatcaaccaagaactgcaggttctgaaattagcattttgtattttagctttttctccaagctcttaatgaataaccttcctctcttaggatgcctgagacttgctcttttgatagcctttgaggtacttgttttctcggcgcatttactttggatcatggggcaggagcttggcagtcctctaaggtttcccacaaaaacatttgtgatgtaagtttaatgctttccttccgttacagagataaatgttgtcagtaatcctgagtggcaggctcaatgtttaaggcttttggaattatgtgagtcccagggtcatgggaattataatacattgaaatatttacaaagcaatgttcaacggattcatgatgtggggttctagaaacaatatggttttgttaaatattccagcagcttccctttctgcatttccgtcagttttattatttctgcccccccatcttttcaatttatgctttttgctttcagccttcaaaacatctgcgagcttatgatatatcagactttgccctacatttctatgtggctactcttcctactccccctctgttgttctcacctcctcagtatctaaagtccccctcatgcttctcagattaaatctcccactcttgtaattgtcttcctccttttgcttaattagataatatctgagacaactttgaagacactaggtgctatcctggtgctaagtggaattgtcataattattatcttgaagcctcacatcaccctaatcagctacttctctcttattctttttctccctcctagtcagctcagtatgaataaagaaaacagtctttcctcaagtggaaaattcaaaatatcacagagttcttttccctatgttgcctgctaatggaaattggggtatattcatgtgttttggcctgagaaaaaagaacagggaaggttaagacatgtgtattgtaaatgatctggatcttttttaatgactctgtttttattactaaaccaacacaaaattattatagagaatttggataattcagaaggcacctgaatgaaaagacatgttgtgtgtttctaccttccaaatttgtttgtatgtgtatatatactatagtcatattactgttttttcacacgaaaaaggtagcttaatctgctgagcattaaataacattaaattattttttttacattatcacaatcatgaggatccctcctacacatatagagcataacttatttaaccagtcccctatagatgaaggggactggttattgatttccaacaatgaattcggctaatataaactatggtacagtcaacattctttatgcacagtcattataattttcaaaaaaaattatattttcaaggcaaatttctcattagttttactggttcaaagtatatccatatgtgatatcatatataagcatatccaacccattagcactggctatttagaaaaatacccagaacattgtgctcactatcctgctgcccatcatggttttggttagaaaatgacattccatcttggggagtctcttgccccatctttgcttatcttgggcaactcacactggatcaatcggctttctggtttgatatactttggaaatgccaaagttggattcttagagaggttctatagaatactcaggagcttcttgtaagcaaagtcctgtatctcttggaaatcagttgtttcaggatcaagtacttcatgttcaaagaactggccactagaaaacaatcactctggtgttatacaaaattacaaggaaaattctaaaggaaggaagaatattaatgctccttgaccattatacagtgcagacatcgtaacctctcaacaaccttgtaagacaaatgaagtctcacctttattttatagtttatcaaattaagctatcaagtagccgaggcataggagagcctagatccaaagacttctctatttgacaccaaagactacggtctttctttccctctaatactcagttatatacaactcttcagagcagagttccaaaagcagaggagaatctgcatctattcatctttagttttttcttcttgttaaatatctgtttgatatgcattcgcctatccaagtgttaggaagcaacttttctcttgctttacatgtggttcatgttttcattagaatccttgatgtattattattctttctctttaactaaaaatgtaatatatattcatgaagcctctgaataatgttgtatgtgatgttatttaacctgtcttgcaacatttgtttataaaaacgatacctacttttgcaggaagtaaacattctgattcaaaatgaacataacctgtgggcctcagggtgatctatatccatgtgatattggctgaattcttaaggagaattctgaaattcctagacctagatgttttgtaaaccaaacagtggacggaagcacttaaaatcacaaactgaggactctagcaacaacaaggacaacatagcataggggttctaagcacaggcaggcagctttagaaccaatcttaactctgtctcagtttccttctctgtataatggggagatactaatgcttgagattcattgtggcggctaaatgagctaatgtgttttccagtgcttagtagagtgcttggcacatcagtttgatctcagtggatgatcatggaggaaaatatactttaagaagtagagaacagtatcattaagtgaatttgtactgaaaagcacaaaaaagatagaaaaacggacacttctagtatagacatcaatgatagtatcccttttttattataaaaagtgccatgcagaatccagaattacttcataagcttaattttaaccaattacaggaacaatgttttactccttttagaatcatattcttgcccttgcgctcatttaagaatctgagaaaagctttgcgttctccaaagaaatatgcacattcataccacatttctcaattttagggaaacccatctattctagatcaatactacccaaaaacatagaggttataggtcacacttcgtttatctgaatgaggtcagaagggagaggctatagccaactcagggctccagtttagtgtacctgaccccaaagccagaatcctaatcattgctgtttactggatacattctctgtccctaagaattcataatgtagaaaggaagacaaatagggaaataaaattatagcatagtatggcaagggcaacaatacgtgcatgtacggaaggaatgatttcataatgcaggttggcaagaaggcaacaaacaccatgaaaacaactcccacttaggctgacttcacaagtacagcagtggccccagggtgtgtcagaattttgggagattttacagattatatgaccatacacaatatcaaaatcaaagtcccagatcagaggtaactcaaacaatcacctacatcctttcacaccaagtctatcccccttgtctctatgagatgaagaagaggcagagggggaggggggctaaatggaaacttgttaggagacatgccttcaccctttgtttaataggttttattcacctgtaatactctctaaagactatgttacccacgccaagccttgagagtcctgaattcttgactgcaaatatccagagaaggaaacagacatgcttgacccctcacacccataaccttgtttatgggctctaactgtgtcccaggcctggaacaagcaagaaagagaaggtactatggaaataggctgcccattcaatgatgcttgagtgagcatgggagacaaaattagagtaatttctcccttcaagtgcattgctacctccaccagcattagacctttactgcttaatattttccttttgacacacctaaattccaattatagccctatacctgccagctgtgggcaagttacctaacattgctgaacactcagagaacacatactgactgctgattttatacctggcacagttctgagtgctttacatgtggactcagcccaccttcacaacacccttctggagaaggaattattattattattaccatcagatagtgaaattcagggggacaagcaacctgctcagaaatcccatcactgagtatatacccaaggaatataaattattctaaccattaagacacatgcacgcatatgttcatcacagcactattcaaaatagcaaagatatggagccaacataaacgtccttcaatacctagtttgttgagggtttttaacatcaagggatgatgaattttatcaaaagccttttctgcatctattgaaataatcatgcagtttttgtttatagttctgtttatgtgatgtatcacatttattgatttgcatatgttgaactaaccttgcatcccaggaataaagcctacatgaccgtggtggattagttttttgatgtgctgctggattcggcctgctagtatttgttgaggatttttgcatcgatgttcatcagggatattggcccaagttttcttttttcatagagtacacaggtttttaagctctgaaatcagatcctcactttaattctggcaccatataattgtgaaaccatgaaagagtcattcatcctttcttaatctcatctcttcatctctaaataggatatgataataatagtgaccttataggattgttaaaaggattaatagagataaagtcttttattaagtgctcagtaaatgtgaattcttcttttgttccctgagttcccttcttcgtgagcagagcagagcttgcccatagctgtgctccttgttgcctcagctcacctaatctataaccaactttcaagccctccttgaccctcaaccaagcatcagtgatgcctcttctctgacatcctcaaggttggcagagttcccattgccactgaatcacacttgacagattatttcccaactgcatcatagcggtttttggtttgtacaaccacattgcaagggcagtattttacatctattccccaaacctgatgctaagcagtaacatgctcaattaatatgtataatgagttgaatgcattgtatttgtcccccgaaaaagtatgctctttaatggcacctttattacaaaaagtgaaatatgagatttattttaaaaattaggaaaactctgataaccaaaaaagaaagtataaattatcataattcacatcaccctgagataaccacttctaacatattgttttagacaatatatgtgtgtgtgtaagaaacatatataaacacatatgtgtctccaaatttatatatctaaacatataaatctccaaatttggagtcagatggtaggttctattttaacctgcttttttcacagaatatcttacaaacatctttccaggtcattaaatattctttacagcataattttaatatgtgacccggcatgtcccacacataagtcatgaatactttaagccctttcttctctcattagcaaataggtagcttttgtattttaacattataaacaatgctgcaatgatatatcaggaaggaagttaaatggaattctgggaaaggaattctggggtccagttggcttcagtcctgattgtctaaccatcttccaggacagctgtataacttataccccagcagcctgtttctccaccagcacacaccattatcagggtaatcggccgggtgcggtggctcacgcctgtaatcccagcactttgggaggctgaggtgggtggatcacgaggtcaggagttcgagaccagcctgaccaacgtggtgaaaccctgtctctactaaaaatacaaaaattagccaggcgtgatggcacgcgcctgtaatcccagctactgaggaggttgaggcagaagaatcgcttgaacccaggaggcggaggttgcagtgagctgagattgtgccactgcactccagcctgggtgacagagcaagactccatctcaaaaaaaaaaaaaatcagagtgatcatcctcaccatcgccatcaatttaacaggcagaaagggagtacccagctagtgagaggtgaggccagaatttgaatccaagtcatgtctgacagcaaagccatgatttggccctgtctaccctgcagggtctgcctgcccatgactttgctgatgaatgtaaaattcacaggctctagggagtgagagtctagcttgactagagatgtccattgtgcctctttggggccccgttttttgtaaggccaaatgtttgcacatttgtgtccatttgtgtggaaatctctaaacattttcagttaaaggagaaagaaacaagcaagtgaggtgctagaaggaaagggatatgtagagtgttatgcctgaaaagagggtgatacacagcagaacttccccagctactgctgtgtctgctctctccataatccagctttctagggcactagaccccttgaagacaatgcttcttccagtgggtttaggtgccacctctctcagaatcacttggaggtccccagttcttaaaaatacagattcttggaaccactttttacctataaagctggaatctgggatggattcttggtaaatataataagtgacctcagcaagtgatcaaaaaatttgagaaccactgtttaaaatctcatctctaggaaactgcctgagtatctttgtagaatccaactctatgctgttaataatagagcttgttaacatttactgagtgcgtgctgagtaccaggcactgttctaagcacttttacaaatattaagtcagggagcgtacttggcaatccagtgacattggtgctaatattatctctattttacagataagaaaacagaagcacaaattacaccaatagggaagggtacatccacaaggccaggctcctagtcactacgttggagtattttcttggatccctcacaaagtgctcctgcagccaatactctggaggcaatatgcaaagtggttcaggaaacccacattggatcaggcaaatctggatctaagttcctaactcataatggtattagtcagggcccttgcaggaaacacttggcacattcaagtgggcaatttgaggataagtaataaagagattctctgcaaatgtgtgggcagggtgcagggaaacctcaagaggcatgcctgagggctggcattggccatagctccttgaccaccccaagccctcctgccagtgcttccgactggccaaaggcaaccagaaaccagaggacaaaagagcaggttgaggcagtccaaagcaggcagcctctccaggcacagtgcagaggagaagggggcaagtagatctggagggacaaaggacatgtttctcaacctctgagtttcaaggttgtcaaatttaatttaagaataacaattgtacataaactcatggacttactgagttaagtaaatagcataatgcttgtaaagtgctgagcacagatgagcacagcagaaatgtttgctgcggttgttatcaattgctctcaaaaaaagggctaacgtgaaaatgtaggaccatcctctatcgttccagttttattgcttcctatgtctcactttatccaaggaatttccttctctttgaccctcagtttcttagtctgtgagaaaaagaacaacaataactattaccactattattgctactacgtattcaccattattatgtaacttgatgttggacacttttggacctcttatatttaggcatctcaccaaacttccttaaggggattattgaaagcaaagccaatgaaactacatcatataatgattgttactaatcaccattctttcaagattgtggtgctccactaaatatgcacattggcttttaaacaaatccaggctccagtcccaaaggttgcaatagacttcagttatttttgtttaggtttcccaggtgattctaacctgccctgctgaaggactgtcttaacagaagacaaataagctcgaggatgtgtggaatgggaggcaagggagtaagtgacaaagtcctgagagtcaaccaagcatccccagcacaaaacagcagagggagcatagcggatgaaacatggaaagggaggcaaggggtccaggggaggtctgagcggaggcagagaagatcatgcagggtctgtgggccatgcaatggagttcagattttaccctaagagcacaggatgctcttggagggctctagaagggaagtgacagactctgttttgtgttttaaaagaccattctagctgcagtgaggaaagtggaatatgggggagcatgaggaggctgatgtgagtccagaaaggaatagttttggtttggagtcaggttgtaacagagaagtagaagtggaccccttcagcatatattttggaggttggaaaacagtgggaattaggggaatcatagtaacctgggacccctgcacacgtgacggtggggcggtgctgccctctgaaaatgccatctcactgactgagctggaggcttgagggcagagtaactggaacagaaaaggagaagggtgctggatgcttccctttgcccttccaagtccactctccatcttttccaccttgcactatggtgtgggaggagtttacgtctggcttcctgttgtctttggctaaagggtagcactggcagttgctgagggatgttaagggattattcctggtcctccaagcagggtcaccgccagttggctgcattctttgaaaagtggtcacagccccatcagctctctctctgtctcccctggccaccccctacctcatcccaggaattattctctccctttgcccctaatcaccaaaggtagtaaccatcagaaccctgacagatgcacgctgacaatcccactagggcagatctccctgatgctcaatgtgagccttcctagggagcactgtgatgggggccactcatgcttcttggggatgtcagaaatagccatcttacctgtgtctctgccaggcagaaagaagaaatctttgctaaggttgatttttgggttttgtttgtttgtttgttttgcatgtcgagtcttagaatttaaaaaaatctatcacccctgctcactatgatttcaggtcagagtctgtaatgtactattaggtgttttatttcccttttaaagtgacaacagttaggatgaacagccagataaacaggcataaaccaggaatctgccctccactcactgaggaaggacccagggtatgtcattctactgtggactagtgaaagatttttagtagactgcatttcccacacattaatccatcatctaccacatcccaaatttccataactgcatccaaaataccatatccacatatgcatcaccttcctgatatttacctcatttctgtaaaaaaaaaaatgactcactttctaagttaattcatgctaaaggaagcttcctatcagtcataagtagaaagccagcattacttgctgtcaataaaaagtaaccaaatagtaataataataatcaaaaaccatacaaaaaaggtagcagaatatcaccgaaaaaaatcatctcacattctacactttgagaaatactgtactcaatgatgtctacaatctcttcagctccgacaagctatacttctgtaaaaataaataataagattaagaagatagaatgtctgcagggcatgtgctacccatatcccctggttcagtgtctttcaggatggctacgaaggagaaagtttggcaggatcgcagatgggggtgacacaaaccatatcatcctatattttaaacaattggccacacatttgaagcgtggcattctgggttctgtttttgtctcccaatgtctcagagcatagattgggcaatggctcactgatggtcatgaccctttcgccctgatgccttgctagcccaccttctgaatagcagtctgggaaagccatcttcaaacactgaggggtgtcatcctcaatttgcagcctgttcaaggcttttagacaccattctgaatgcccaagaagtttctccttaagaaaatctgcttttaactatcaatatccaatgctatgctattttttactcccagcagattccaagtatggagttcaaaatgcatcataatagaagtgtgtgtgtgtgtgtgtgtgtgtgtgcatgtgtgtgtgtgtgtgtgagagagagagagagagagagagagagaagtcagctcatctttaattgaatgtgtcactgacgtaggagacaagacaggtaactttagggtctttgaagttagaaactaatagttcttccagattccaacctgagagctgtgtctatgtgaccatagctagattcagatagcaccactaaatgcaccctgggaatacatgatggagagcgacaaaagtaaaaaaggccaaaaatagtgccttctcaatgcaaggaattgactacttcacctccaaaatgtttctattccatgcccatccatgtatgtatatcacatcaaaatactagttttcatgtgatcctaaaaacttgaaacccctgatttttttcttctgtaaaactgcttacttcctttaaggcttcccttcaaacagtggttctgcacctggctcacattagaatcagctgtggaacttttggaccacagatacccagaacttacttgggtgaattaagccccaaatctctgcagttgaggcccaggtatttcagtatttttgcaatgctccccaggaacttctaatggacagccttgactaagaacaaatgctttagaaaaaggatgcaagagaagtcaccttccctgaccatatttcccttccctgcttgttctggtaggatcaggtgagtagcagggtcacagggacacagagttagccagatccaaagcagagacaatctgggaggaagaaacaatagacattttcctcattccataaaaacataaaggcatttctacgatgtgctaggcacagttcaagagggatcatggtttagagaaccagagagaatggttgaatcctccaggtctctgggaattctaccatctcttgaagacaagcctgcctgatggaagggtttggccatgaaccagggaggaagttctaattagaaggctctcttagtccacttgtgttgctataaagtaatacctgagactgggtgacttaggaaagaaaagccacacttcttgtacagcctgcagaaccatgagccatttaaataaatgcaggctgtacaagaagcatggcatcaccatctgcttctggtgagagcctcaggcagcttctactcatggtagaaggcaaagggagccagtgtgcttagagagcacatggcaagagaaaaagcaagacagagagaggggaggtgccaggctcttttcaacagccagttctcttaggaactaagattgagaatgacaccagccattcttgaaggatctgcccccacaaggctccactaccaacattggggatcaaatttccacatgagacttgctggggtcaaaccacatccgaaccattgtaaaggtcaaaggagactttccttggttcttcactagcgaacgcattatttcccagacagcaatagcagcttgctggagttgcctaagtattctccatccccttgctctgcacctctgtgcattatatcatttacatttattgtttagctgttcacctgttcactttgttttcctcttacagcataagaccaaagagaactgggatcatttccctcttattcattgcttatatcctcagtacttagcccagtgtcttgttcatactggatgctcaataaatatttgttcaatgaatgaatttaataatgttttattctcattgtattaaggtgtatgtttatgatctattaagggcaagcgacactagatttctgtttatagtagagatagtctgctttttaaatgagttagtataaggaaaaagggaaatccatttacagaaaaatactaagtaaatagaagcctaaggggtgcatagatgtgacatcactcatgggaatgataagtaaatgactgacatttgggaaacactagtctaggaagcaggtctggaaacaaagaccaaggaacaagcctggaaatgaggggaatactacctagtctaaatcaggatgctggctgaggtacgattcaactagcacttactgagcattagctgtgtgctcagagctcagatggtgagtgggatttggaatccaatcccatcttcaaagcattcacggtgagacagccatgggcaccacgatagtagaaatcaaaatatataaagctccaaataggccagagaagagcagtgtttgttcgcccagagacaatcaggaaatccttccaagaagagaaatttgagtagagctctgaagaacagggacaatttgaataggcagaaatggtggacaaggcaatctagactgagggacagccagaacaaacccaggcggaatagtagcagcaactgatttagggaaatgatcacaggacattctgaatggaatgtataggctccagtggaaaatttatgtaacactttctgtttgcctgtttattcccaaggcatcatcccaaaggcatttctgatgatagtgtccatgtcctcatggagaggagatcctaggagacatctctacttccaaattaccaaccacagtcttccctttcctttccattaaaaaaaaaattcagaaagcactgtcctgtcattcccgtaataaatatgcaagcagcaatcagtagctgccctaatttgcattaatgggatgcctgtccttgagaaaacccctgaaaaatggtgacattgctttgccagaatcctgagcacctctgcagacagagggctgccctccatcagcaccagaaatccaaataaatctacccttagaactatcaagagtccaggccaagcaaaaaggcgctttccctcttcatctatttcaagagagaaaactatccttgaaaagatttcccctgatagccaaatgcataagcctccttgtttccccttcccctgctgtttaagcccagcaaccccctgatgggtaatgaatgtcctttgcgtggccttatgctatttttcaatactgtatccccaagtgtcaagtttataacttcagtgttcattttttaaagttggtgtgatgtagtgtggcactttatcttcccaatgtacatcagagttaacattctacttaattttgtcaaagatctttgtcttgagttacagcatggaacagaatattctagggaggtcttgattatattaaataatgcatagagaaatgaacctgtcttcccagtggttccaaaactcctgctggtctctcacctccttcccacatgttcatatctgattttgagaaaaatcccacttggaagataactacaggagataaatgacctctctcttttctttctttctctgaatcaaaaagcaatccatgaagtgtgtctccctcttgatcatccctcatcattaacatctcattttaaaccaaaatgtgtttcacagaatgttaatgactattatgcaacctcaatttggggtcaaataaactttagggaatactgagttaagcaaagttaagcaggtatcttttctgaggtcatgtccaagcttttaataagtaactctgcactgttaatattcaagagggccatgcaatatgcaacaattccagatttactgtttttccatgaaacccttttttgatggagcatctcaagagactagacttaaactagcaaaaagttgcctatctctggctgcaacagacactcaaatgtcaccctgaaactgcaactcccagggcggttaccattgttgcctaaaaaaaccactaggtttctaacactaaaacgtgttgtttgagtcagggtttattcacacttactattcttccagtttgtatgtaagaagatgcattttttttttacttatacatataggaaaattaaggccagggttttgtctttacttcattctcacaacaagaaatcacctttgcccacaaacatataagcaccactcagcactgatggagtactacgcgatcttcctcatcccattttgaccagagacacccacagagagaggtctgcccagagtttggtgcaattctgtttcctctagagctgaaatatatgatgtcttcatcctttgaatgactagaggtatcaatcatactccctccaataatttgagaaataagtgatccatagaattgacacccaaaagaaaccaaaatatctgtgttgttaaaggtaaagctggattaaagaactcatgaatctcctgtttacagctatcctcagtcaaactgacccccttgcccacagtgggcgatacaaagtttgatcactagcttgcctgactctagggtctgtgtatgatttttttcccgcatttatacacacacatagaaggaagacagtcattcttcagtatccatgggggacccctggggaaaccaaaatcctccaatgctcaagtccctagcataaaatggagtagcatttgcatatagcctacacatatcctcccataacctttaaatcatctctagattacttataatagtaaatgcaatgtaaatgctatgtaaatagctgttataatgtattgggttttttatttgtgttattttcattgtggtactgttatttctaaattggggtgggtgtttctgaatatcttcaatttgtagttggttgaatctgcagatgtggagcccaggtacagggaggtctgagtgtactaaaatgtttgttggaactaaatgaaatcacagagattctgtggcttccccgtgctccataccacagaagctaaatgatcctagaatgtgacagttgaacctgaaaagttaagagatatgcaaattccaactggactgtaattgaaatccatagaagttgatgtcttgacagataggaaaaatataaaagataattcaaaagagaatatattagtaaatggatttaagtaataacaaaagaattaagtaaagatttaaactcaagggattggattttggaagccaactgtccctaaaggccatgaactaggaggccctttttggcacagcctgggcctaagacaagtggctcctgtacatctgaagctcccaatttaggtacctaacacactcaggcgaaaaggatacaatatctttgggagtcactcatccaccattagttagtggtagggatgaggggatgtgggaagggaagacccctaacttgacttccccactctggcatggtgcattgctaatagtccagcagctagcgggaagggacacttcagcaaagttgttgggctgctgctccccacccctgcaccctgacccccatgcctgtgagggccagtgagtattcccatgaccaagggaggatattaaataacaagtaaaaacaccctaggagatgtgagactggaaggagataaaggaaggggaaaaaaaaactctttttcctgctttttgaacaaagaactcccatattgttatttttcactgggcccagcaaattacgcagcctattctgccttttttgtagggtgagggggcacacctaacctggcagtcatggccggctgtgttagccagggtggacactgctcctgggtggcccatggtgcttcccagcctttgactagggagttgtgttcaagtggaaggagatgtaggagcactccctaaagtctccaatctatcttcactggaaggttctcttctgtatattgaggaataataataccagcctctcaggattgttaacagaattgctgtgatgactaatttggaataatgtaagtaaaaacactcagcaaagtagcagatgggaagcatgcgttccattaatagtagctatattgcaaggtcttctaggggtgcttctcaagttttcctgcacatacacatctcacaggaacttggtttagtgcagattctcattcagaagctctgcggtgggcactaatggtctgtgacctgacactcctggtctcaggaccatactttgagaagcaagcccctcagagatacaaaatgaacacaactgtctccagttttaaggagttatggagagaaataagttttatggggagaaactagacatgtagtcagctagctaaatggcaaagcagagtgccagtataaacaaattgccttgaaagagacagctattctctcattgtcactcacccaggctttgtgggggagttttcatttgagctgaatttgaatgatgagtagagtttgagtgggttttgactcctgggctctggtcctggctgtgccagcagggaaacattcatggaagtgggaaacatgcaggaaattaaggagatgctgaaagccctacagagcccaaagcttaaggtgtggtgaagaggaggaggcaggcacatagtggaccgcgatgctggaagactgtcacaagtatcaacagaacacagtccagggtagttttatgcaaatgtattagtatcctagggctgccataacaaagcatcacaaactgggtggtttaaaacaactgaaatttattgtctcatcattctgaaagatacaagtctgaaatcaaggtaacagcagggctctgctccctctaaaacttataggggagtcattccttgcttcttcctggttttgggtggaatcagagattccagcaatctctgatgttccttagcttgcaactccatcactccaagctctacctcggctaacaagtgatactccccctgtgtgtctatttacataactgtcttcttacatctgtcacattaggttagaggtccaccctactcgagtataacctcatctaagctagttacatctgcaatgacctcgcttccatataaggtcacattcttaagtattgagggtctagacttcaacaaaagctttttgggagatgtaattcagtccgcaacagccaatatgtttgcactcattgggcccaagtaatcatctctgccctatcagataaacttcaaaagtggcctctgcccagtgagccctgggaacaaatgaggatccagagaccctctaccttttccatatttacttcctcccaaataaacaaagatctttagagcatcctgggcttcactgaacctagctgtaaacttagggcactggtgttggggaaatgagagtagcattagaaatcccattgaaattttctctccatttacctacttctatatgaaggttacgtcattcccaaggagcttctgggactgtaagtctaccaggttgctccctaatgcattcattcacatagcaggattcaataaaataatgacttacgatatctttctccccaacttttatgagaagcagtggccttccattctttccctttgttcttgctcaatagaagacgaatgtaaacaaaatatgaattttgtaggcaaatggaaaggagcattggctaattattctatcaaattaaaccatcctctttgaaaaactggaactttcaaaaattaagtggctttccctctttcaatcgtatgttccctggctccatagtgaaggcattgtcacctagctacacgacattttatgttccaaataacagttcttcctaatgtcttagaggttatcagcatgaaagaagcatttcacactaaacccctgcaagtattgccatgagcaataataagttttttaagctcactctgtcagactgattatccatcccagattaattcagagcatcctttctctgctaaaataaagatgaaagttggctgcactgtgtgggcaggagaagggatggtgtggaaataaaagaacataaaatgagtatctgttttcgaggcagctgagaacaagctgcaggcttctgtccttgctgttgtctccttttagagaaaataagcccaagcagcttgtttaagtaggtagttaattttaaaccagatttaaagactgctaagaaacacactggccccaatccaggccatggtcagttgctgctaaatcccactgacgtccataagacgcaaacaataggtcccagacgcttaggcacagacgtgcaaggttttacatccttatgtcctcaggtttgtcctaagcaatttagtccattgcccaatgaaattgtaatacaccatgctaagataaaattaaactatcctctacaggtcaggattaattttgcaaactccatttcctggagataattggtcactgggtacttataggaggattagtccacttgaagttttatctcctcccctgaaatcttccccaatccttccagcattgaattaatctctcgcctttgtgttcccattgcacttgacctatacctcaattatagcacttagcacagtctctctggcattaccgttatttctgtgatcttatctcccttactagactgcaggttctttaaggaacaagactctgtcctagtggtttttgtgtttctaggatctgggacagggtatggtgtgtccttaatagacatttattgaagaactgaaggatggaaatgaaagaagaatttaatggttacctctatcattatcaaatgtcactatctcctcttacacaaggtcttaatcaaatcccttggaagagagctctggaatacttaagagattctggaatttagaaggaagagaagaatttcaagggaatttaggagtgagccttttgggagattaaagaagcaacaaaaacgtgcatatggaaaactcatttcaattagtcctttttgttttaaagattctgagaattatcagggatagagataggttttgtatcaccaagagtcctaaggttacaagtaacagaaattaccttggggtaataaaagcagagaagggatttattgtaaacatgtgaagacattcacataatgaaagggaaggctgaaaactggcctccaaaacatacaggaaacaaagcggctcaaggcacatgtacagtggaaactaacaaattgcttcaatttgtagttcaactcgtgcattgttataggcatgattcaactcaaccagccatgctattcagggttcaaaatctagaaaaagagccttgttggtctgagtttggacatatgcccatcccttggctatcgaatagacccttccataaaagaaatgcagtctctccaagagatgtgatttcccaaaaggaaatcaaggtgccattaacaaaagaagagagattgagtgttttggcaaccaaagcactgataatgttgctactgtcgatgacagtattcccttggaaaatatccaaattagaaaactactttaaggaccagaacactcttacagctagtaggaaatatgtgaccctagaaacttgtatttaaatagatccaacttgaagttcaagtacaacacatttagacaaatactatcaaatagcttgtccaccattgatgttgttcatgtatgtcagggctttattaccttgttaaattgcttagaaagccatgttttctaatagaaaaaaaagaccaaataaatcccagaagaagtcatcaaataatggctaaatctgaaactggagttgatgagaacattaaggtaactgaatttctgtcaacatttttgtgctttctcatgtgggtacagaaccaagttatagctagaagaaaaaatgaataaactggttttgtttagtgaaattgtagaagttctagaaattacattttttctcatttgcaatatctcactttaaaaattaacacataaaagtcacattttgtcagcagatatttattgtacctctcttactaatgctaatcatttaaggtttttaagtgcttctgtgtatcagatactctgctaagatctttacctacatttctcatttaatttataagaacctgtcagtacagttagtgttgctataacagaatagccgagactgagtagtctataaagaaaagaggtttatttggcttacagttctagtggctagaaaatgcaagattggacatttgcatctggtaagggcttcaggctgctccagctcacggttgaaagcagaaggggaccactgtgtatgatgaggtaacgtggtgacagaggatgcaaaagttggagaaggtcaggctctttttaacaaccagctctcatgggaactaatagagtgagaactcactcatcccctctctccccagggtgagaaaatgagtaatctattcataaggaatccacccccataaccccagcaccttccaccaggcccacctcccaacattgccacattgggtatcaaattacaatatgaaagtgaaggggacaaacagccaatcatatcagaacccaatgagagtagttactgtcagtattaggaaactagggatcaaacaaattaagtaacttgcctatggttccacagctgataagtagcagaattaaagtaaagaaaataattgcatggaaaataaatacactctgcatacatgcatacatacaattacagatgtggttaattactttagtaattattttctgaagtaattaaattacttatccttacaaagaacaattcctcaataaatatatattaaaggcaggaatttatattgtgatactaaaaatatgacttccaagaaattttttgtggataggaaaaaagatcatcagcataaaaggccttttgatatagactacaataacctgtgattccttctactgactctgaaaatgattttccgttgttttagtaggactacatacagaagaaaaaagaactgattaatattttttacccttgtgtctatttgctctggaacaccttattaatagagatggtggaatgtatttctctaacattaaataaaatctaggtaatcaagacagcatagtattggcataaggatagacatatagaccaatggagaagaactggtagtccataaataaaactttacacttataatcaaatgatttttgataagagtacaaggcatattaatggagaaaaaaatagtcttttcaacaaaaggtgctgagacaactgaatatccacatgcaaaaaaaaaaaaatgaagttggcgccctacctcataccatttacaaaaattaactcataatggaacatagaccatgtaagagctaaaactacagaacacttagaagaaaatataggagtaaatttttatgaccttgggctaggcaatcatttcttagataatggtatcaaaggtatagacaaccacaaaaaaatagataaactggatttcatcacaaattttaaaaacatttgtattttaaaggactctatcagccaggtgcagtagttcatgcctgtaaccccagcactttgggaggctgagatgggagaatcacttgaggccaaaaattcgagaccagcctgctcaacataaggaaaccctcatctctacaaaaaataaaataaaaattttaaaaatttaaggaatgaaaaaacttttacaaagtaattcatcaagaaagtgaataaaccatctacagaatggaagacaaattatgcaaataataaatccaaaaaggaacttacatccagaatatatgaagaattcttataacttaacaataaaaagatgaccagttttaaaatgggcaaagaacttgagtagacattcatccaagaagatatacaaatagccaaaaagcacattaaaaggtgctcagcatcattactcattagggaaatgcaaatcaaaactacactatttcagcctccgtgagatggttaaaataaaaaacacagacaataacaagtattgacaaggctgtggaaaaactgaatttctcttacattgctagtgggattgtaaaattgtaaaaccactttggaaaacagtttggcagttcctccaaatgttaaacatatgattatgttaccactaaactgtatgatctagcaattccactcctaagtatatcacctatgagaagtgaaaatatatgtccacacaaaaatctgtacgtgaatgttcctagcagctttatttataatagctcaaaatggaaacaactcaaatatctaccaattgatgaatgaattttttaaaggtgatatagctatacaatggaatattatttagcaatataaaaggaacaaagtactgatacatgcaacaacatggataaaccttcaaaacatcatgctaagtaaaatatgccagtccgtttctataaaattttcagaatatgcaaatacatagaaacaaagtagattagaatttccagggctgagggatgaatgaatgggatacgactgctaataggtatgaggcttctttttggggaaatgaaaatgttctgaaattagatagtatgtaggttactctgtaaatatactaaaactctgtgaatacatgaaactatgaatatatgatagcttactgaaacgtgcactttaaaagggtgacgatatgttaattttatctccataaagctattacttaaaaaaaaattagggtcagtcgtcctttctctgagatggtaaacttgcaaaatgacttgtacctccccaaacttgccattttcagactcttttataactatgtacacactctaccctttgtctacaaacttctacctactttcccatctcacttcaacccctttcgtgccctgcaaatttcttattcttccttcatgagttggctcagattttatctctactagaaaatctctctgaatccttagttcaacgttgaattgcatttatctgaaggtccagctgaaccatacagacatctttattctggcacaaatcatactccatggtaatcttctgtttatgtgtcagtctttcattagtgtataagcttcttgaagcatttgtctttgtgttttgaggtctggcacagtgcctggcacctggtggcaattagaaatgtttactgaagaaatgaatgaatgaatgcttaaaggcagaaaaatgaacaaaataatatcttctggtggaaagattctacgatgtcaggatatattctaatcacagaaagtgtcttagagttcagccttaaatactttcatatgttgaattcaaattacctgtggaaatccatgctacaattaataaatatttcccttctaaatgtgagcttttaagtcagtcctcaagcgacccagggtaagctgagcttcctaagaagaataagaaattcttcttgctctgtggaatattcttgtacaactaaccatctagattacaggatcctaaaacttttctttgggacatctacccctggttgtcaataaacctgagaaagttaagagttgaatcatgaatctattgccataggacatacagcctctggtggataaatttaacccagattactgtctttccaaaacaatatttccttgccctaccacttaagcacactgtggtttgaaacatttgaatgggattatcacatagacaaaaaggattaataatttacaatgacatttgatcgtgaggcttttttgatgcacaaatccaagtatttaagaagctgatggcatcctactagagataagaaaccactataagtaaacaaaacaaaccctgaacaactgccttcacagagcttacattatagcagaagagatatgtgggaaaataatttcaagcagagagaataattaatgtaatggtgagaatacgttttgtgaatggaaggaggccaaagtgctgggatatagtgaacattacacagcagttgatgataattaatattattctcggtggagtcagaactgttggtcacaattcttcctccccttcctccaactagtattttgcaaagccacctttgccgtgatctcataaaaacagtatatttatctgccccattgattttgggcttggtaagtgacttgttttgattaatagaaagtgggcagaagtgataggatgtcatttcccacatgaggccttaataagcattgcatgtttctgcttgccatcctgtgcccccaccatcagcaagagaaggcttcctccacgtggagggatccctcttcatcctgagtcctagaatggacatgcatgaagcagagccacttcaaccaacccataagcataagagcaagaatagatggtggtggttttgaaccactgagtttggaggtggttaattacactgcattatcatggcaatagctaactgatataatcttcaatatgaatctcacacattattaatatatctttctatgtcttacttttttaaatatgattttattgtttgtatagtctatagtaaccaaatcatccctgggaatgataaaaacaaacaggagcctagctaactatattcggaagaaataagcctcacttaactagattcctgatttgctctcatcatttgcttagtttcaaggaagcaaaggccctttctttcttcccttcttctgctttcacctctgcaccaggacatctgttgtttcagtttcagtttgaagtttttgcatcactgaaaaaaatatacaactttgtagcttacagtttatattttggcatctctgtgtgttagtattagtcattcaatagatgggtgattccacaacaaagtagaatccatgaagggaggtgtgaagttatttttataaataaacccaatttttggtgcattttcacaagttttaattcctgggctcgagtttctaaaggaagttcaggcttttatgcatgtgtgtcccaaacttgaacctaacaggaatgcaaatagaaaattaatctcatcagacatatcatagaacttccttctctggtatctaaatactaaaactgtcctcaaaacatcagttattcagcaagtagttattgaatgtagatcctcaaaacatgccaagcaatacagagccacaaaagaagggtatggtccttgcccacagtgaaaatatcctgagtaacaactttaaaaatggagactgctctgagctatcttaatttgggtttccctaaggcagaccttaaaacaaagacctaggcacaaggagcctttataggaggtgatttcagaaagcacaagaaagacatggggtaagcgagacagagaagggagcaagccagtaaagtttgcattaatgagcaggttatcactgtgggcaactggggctcagtcctgctgggatcctctgagaaactgtatggaacacacccaagaatccccggacagagggcagagaggctgggccatctacccactgacttccaccctccagggttttagggctgaatccaaaaatgttaactttcccacacttccagctgtgcctgcttgcagcatagtaaatttgcttggatagaggaaggccctcaaacagaaaaaagagcttaatgtaggaggcatatcaatatctacaggagctaccacatgtgtctgctagaggagtacggctatttatttcatcagttataataatagtatttattaaacacttattatgtgccaggcatggtgctaagctttttacagacaccttattattttattccttatgaagtaggtcatgttattatcaccttatgaagtaggtcatgttattatcaccttaattattaggtagcaaacagtatattaaagattgtgtttaattatcatcttctatagacaaagaaattaagaaattagctcatgtgacacagcaaggaagtggtggagattttaacgtgagtagtctgaacatagagccatggtctaagcaacactttactactgaaggggcaaggtgcagaaaacaaggtcctcaaagttggggaaaataatgaatcatacaatcctcagggaaggcttcgtggaggaaatatactcgagtagtactttgagattgataaaatggagacatgcagaaaaagaaacgagcctctgcatgttaaggaaggaaaaagagggaaggggaaatggttgtaacataatgggcatgaattcaataaaatgtccacctcaggacatacacagagttggcccttgctatgcagtaaggcatatacaatattgtgtataactctatgttcactagacaaatatgtattgggcatctacttcatacttggcaagattttttttaaaagacccagacatgatttgctagaggagagacacatacagaagacatgtgttatttccgttttttagtattgaacccttctttttaatgaagaacccattcagtgaggttcatgtgaaatttcacctcctatcactcctacacacacacacacacacacacacacaatcccccccccaacacacacacacacacacacacacacacacatatacatagtacctgactgcagcctggccaattagtacatctatttccctggccttggtgattgtttttgagatgaacatgtgacctaatttgaagtttttctcttggagctgggagaacgatggcctctgctagtcagggctactgagctggtaagttgcgaatgtcagacttccattttgcccaccgcagagagaaagaataaaaccaagcagaggcaggcagctttaaggaattaaggaagagacagccagtgtactgccaattcttttttttttttttacctcttggactcagtcttgacaataaacaagagacacatcttacctcaaatttctcagaagacattcctctaattgcacatggtagaagggagtttgattaggtaaccaaatttcattttcttaacatggcttcttataagactcaaccaaccacagtttcagaattacaatctattgaccttagtcattctccgggacagcaaaatgcaccagttctttctattgacctgagttatcacaggccatcagacccactgaatagtagggggagttctggaatagttacatagatttaagatggaaatcttaacttagggtgaattttttcttcattaaaggagccaatctattgcgtactaaatcctgctaatataatcctctttttataaaattatttcccttcccactcactcacttagtcttctttagttcatattcctcggcttgaaatccagactatgaatattggcataggctgcccacatgtgaaatttctttcacaaggtttaggagcccagagaagctaaacatagaaaaagcaaaactaaaattaatttcagaaaagaatgcttttcaatcatgcagtatccagtgtcctgatataaaacaactgtcttctcaagagggcacttgggatgaaaataacaagctaaaaatagaggcacgaggtagcagcaaaaagaggaaagacagagaagaaatggattttatcaaactttgaggtgccagtgggtatttccacagctgatgcttattccaaataaaagttatatgagccattgttttatctgagatgctccagtcacttataaagaagctaggtgaaagtcaactgaatcaataaaaattttgagcaccaaatgtgccagtcactgtgctgggcgctagagacacagtaagaaactagaatctcgttctctctctttatccccatgttttcttctgtattggcctcattattttggcatagaattgagtatacatgccttagatcctcaagcgcagtggctaaaacatgataattgatcagatctacttctgagtttcaaacctgaaaagcaagaaactgttcagaaaataaacaatacatacaggtaagcaaaaacatcagatgcccccttcgttggggatactaagataagtaacactgctcgcaaatttcgtgttgtaaattccccatattaagcctcagtctctgacttccctttaggaatgagataaaggattggagaggtaatgtttatactgagtaatcactccagtgggctgtctaagtctgacctctattttcctacctctagcctgagaaatctggagaagtaaaatggtcaaagaccaaggagcatttataactttagacagggctcctctctgagtcaggcatggacaatcagttgaatagagaatatctaggcagttttagtttggataaaagagcattttattcagtactcactgaggacagagagcacctgccatatactttttgaatgatgatgacaataaaaactattgcttagtgtgatgacttgcatataggagatactcagtaaatacctgctaagtgaaaagaaatacctatgtaaaatggtgaatcaggccatctatcccatattacctgaattaccaaaagtgggcataagtaaaatgaggtaatttgagggaagtcaaaatttatcatctagatcagcagttctcaaatgtgaggtttcaagacccctccacattttttaaatgattaaggaccacaaagagctttttatttttgtagattatatccatagatatttatcatattagaaatcataactaataaatttattaaatacaaaaatatgcaaatgcacattccatgaactgtcagaataatagctgcttcttacatcatctagcttctgtaaaactccactatacacttgtgagaaagtgagagtaaaatgacaaacaacatcttagtgttatcatgaaaataattttgatctaatgcatccctcgaaagagtttcagacattccaaactagagtttgaggatctctgatttggagttgtcagaagcattaagaatttctaggaagccaaacaaaattattgaatattaaattacttgtaagacttatttgtagcatatagtcacatgatttagacattgatttttaatcatcaggagaggaagtttaatttagcttctgttctatttaaatattctgttaatcaagaggaaaattatcagtagaagataggtcttaatctgtgggtgaaaggaattgcttgctgttttggttattttgtttttgtttttgtttttgagccctttccaataattaaataccattttcttttacaaagacttttttgacccttctatgactagatcagtgtcattgacctcattaaaaagtccagtctttcctatcaaacccttgctagactttgtataaaactgcatttcattgaaaaagtgtccaaattggggtaatttatctggagaaagaagttcaggacactggcttggataagcaggaagtagccctcgtcccctacccttcctcaatgccctagacactgtacttgactaattgcttttcactctctagaatttacttcactaaacatcaccttcccttatgtagctggccatggacaatatggaggttaatccaaagaccttgggaataaggtgggtggcggggcgttattctagtaagagaaagaagcaagtgggcatgatggtagcaaaggagtggccatgatccaggtgacgtccatctttgtgggccaggttaaggggtttgaatatgactaagtacaagaggaaaccgttggagaagagctttacacagaggagtggcatgctctgatttatgcttttgaaagatacctggttgctgtgcggaaaatgaattcttacatgtcatgttacaaatacagcttgaagattgtgtgattaatctcccagtcacctgcaaagcattggagacacgggtgacattatatgtgctgacgataaagggtacttttcctatccccagctgataaatacgttcaacaaactgttcctagttaaataaaatgtacaatgttttcttgtgtcttagacattttctcaaaaaggatttgtttatttatggtgatattaatcactaaagaattggaaatttacaattccaaagccgacaggataataccttttcagtggtttaaaggagattgtattttgttctatatgcataagtgattactatttatttcattataatctggcatatatattgaatttcctacccagcaagagttctgttaagttgcctaccctgagcatttagtgaagccagttattacatgaataatgaaatgacagtaagcaataacagaaaatgaccaaataactgcttgattgggggactttttgacagaactgtatagtaatagaatatgcctgtttccagttctttaaaatctactttctaaaagagtttggatttttaaaatcaactttagtaatcagacttacacctttaattgtgagcttttgaaactccttacagttcacatattatagcacctgtaattgtcaattacattcacgcaccatgacaagtacaatatactccatcatctcattcaaacttcacacacacacacacacaatcctatgaatatggtgcttttatttcttccattttgcagatgagaaatctgaagctcagaaacacatgagactcgtccaaggtcaaatagctgaatattgacagagatgctttatattgcctttgatttaggggaaaaaaaaaaaacatgtgaaagggtagcgttccattggacacaaaatggagacaaatagaagtgaaagggtgctggaaataacatttcattgctgggactgatacttgaatattcgttactatgtcgccattgggtgtgagactagatgaggtaagtaatgggtagagggaggaattgtcaactggttttatcatgttggacaaaatgtaaaatagtctcaatgaaacttttagaacccagctcttatttccattttcagcactaggtcaccaaagtgatggggtttagtaaatcttaacattttgggaattaagaaacctaataagaatctaacaaaacttatgtaacatgacccagagtatataaattcaaaatgtccactagcgtgaggctatttagaaaattattatagtctacagccataccaccctgaacacgccctgatctcagaagctaaacagggtcgggcctggttagtacttggatgggggaaaattattatagaaccttcactacctaacatacagaacagcacaatatgataattcatagtcctgtacatatattatatgactgttaaaaaaaataaggcagatcctccttgaaaaagtaaggcatgtacaggtcatattattaggtagcaaacagtatattaaagattgtgtttaatttcagtgttttaagttgttaatattggagattaaattatgaagaaccttaccttttcctcctgtaaacattcctgtattggttgaatttttataaatagcacgttttgactgaattaatgattaaaatcaatttgacctaaattctaaacaaaaggtcagatttctgccaccttcctgtatgtttctaaatgttataaatatcttttaatcaaagactttaaattgtctattcctgatacatttctatactaaccgaataaaatagatgaataagccgttgtcaaccggacattcaaactttttaaaaaccaactctaggactgtttttgtttcacaattcacttgggtagagtaccacagctcagggaaagcaaacgagagaagaaaggattttccctgaaatgtacagataacgacctcaatatctattttaatttgacaacgtagaggcagtctgagttctctattactcaaattctatttgaagagccaaaattaataaatcatagcttagtgagcacagcaatgcctctttgcaagtcactgtaagggtttcatagggttttacttcccttttactccagatcataccttggcctttgcaaaccatccctttttaatcaccttagagtccacagtttcatgttgaaatgtctatctgtgtaaatccaaactgtagggaggagtgaaatttgaaaagatcctggcatatatattcttaaaaccacaatacactttcaataagttggataaacatctttctggcacatggaaatgggagctacatgctgggggtgaggggggaacagtaattttccagccttatcttcacatgtctgagtacaattattagtgtagaaaagagtattgtttgcagtaatcttgattgcattttccagtgtctagctcactccctgtgctcgatatttattattaccctccttaaaataaaaaaatcattgtctctaatggtaaagtggagaggacaaaaaataatgaaaatttcctcttatgaaaaaaaaagttcctcctatggagacaataaactttaagacacttaatgcataaccaaatcaaggagaaatacctctgttatgttgaaaagcagaagtatagcactttgtctttcacttagattttttctttttaaagaaaatatttttagcacgtgcatgctgttgttgcaagccttggagatgaaactgtttttgattcaaccaaggttaggaaagaaatgtctaggaaaatgattctggctgcctggaaaatgccatttatccgaagatatggagttcatctcttgagtctggcatatgggaatgtaggtacagtcatctcaatgtccactgaccttcctggaaacaaatagcatcactggaatccctgaggttctcctagaaaaatgtgtgtgtactagatcgttttatatttctgtttgctttgatattggataaattctagtaatgaccctttttctcaataaagatatcttagatagattgatccttgtcaccttccacaagtgagtcttacatttcagatctactctctctattccccctttgcaaactgaagacatcaaactttttcttaacttaagcaacctgagtccaattgctggagtcttctctcagttctcaccatgatgtgcatattttccaggcctgttctcagtccctacttcgaatttgtctgccttttctaccccaaatagatcctaaacctgagactctgggaaggcagactctctccccacattttgaggacagcgtaatgtgccttgtgaggtgctggtggcataaaggagaatcttattccaatcaacgtgagtttttaggcccagtttggaatcacccatgagccagtggagcaatggaacaatggccgcagttcccatatattcatcctatgagaactgtcctatggagaaaggactgaaagtaacaagtgagagtcagttgctagaaggccattagaaaagccctcaatggtgcaagaagtcaccaaatatgtgattgatacaaacaattgataacattgcactgtttttgtatgggaggttaagagcaagagctttggggtcatacggactccatttctcggccctacttcaaaaagtctccttgctcctaaaattaacatgcaataacttaatagtaatcacttgatcaaatttgaatgtttcagtgagataacagacaaaaacatttggcatggtgcctgggctagtgtatgctcaataaatgtcaatcattgattggcatccagcagtagaagtgaaatcaccatcatcattctaaatagcatcaccgaataccatgcttcaggtacagtaagaaaaccagtggaagtaacagagaaggatttgtctttttcaaccttccagataatctgcactctcattccccatagttcattgtctccccatctgtttctaatgactggcacatgaagttcaataaatctttactgaatgaatgaatgacttgagcataatggagaagtcagtggcttggaaaacgtggaaatgaaatttgggtcataagtaaaacaactaagagctggtatcagaaagcctgagtgctaagttttccactactctgtgccaacaggtgatctttagtgattcttttgagatagctgagctccaacttccctatctgcataatgttggggggctacttggggggaaaaatgagatgcagtgtgtgaaagtgctacataaattttcaggattttgtagtggtttatgttgtgaatcacataagctgagtaagtaagagtgtatgtgtgcatctgtaaatgcacacacaaacacacttattacacacatacacatacatatggctagctaaagacaacgcaatctaaaagcagataagtgccaatatttcatatagggaagagagggataaaaatggagcaaaaggattaaagttcctgtcgactggtaaacagaattgaaacagggcctatcaaaaataatcacgtaaagagaaaacgtactcagcactacaatttgccaattgccctctgatcttgaattccagctaccagaaattcaatgacagcagcctgctcccccacaccttaatccttcccacatttgctcctgggctggatcactgcccttgggacatgtcatttctgtcttgcactgaaccaccgccaaatgtattggtaggagctttagtcctgtttccttccacaccgggtaaaaggttttgtcaataatttcaaaggtcttattatcagatgaccataatagtgtggtgctacctaaagataaatctgtgctttgttttacctaatgtctcactttctattaaaaaatcacaccacaattatcacaatttcacaacatggcatagtcaggttcatttaccctttacttgtttctgaggcaaatgttagaataacccaggacaagatttggaaattagcaagtttttaatggctttctatcggtcagtctacagggattcaactctatcactgctgggtaccttgtacaatgcctaattcacatacttcaaggtggtagcagaatgaacattggtttagaatcctattcagtacagactatcagtctaccgttagatgagatggcacgggaaagctggttgggtcatttgcttacaaatattcagctggaaatctaaggatgctgtaatttttaaagaagagaggcaggtatgcgcagtacttgccagtgtaggctccttctactcttcttacattcctgactcatctctgccatcttctagccacatgacctcaggcaaggtcattattctttccaagcctcagtttcctcctctgtaaaatggtaacagcaatcgtacccactgaagagagttgttatgagcattaaatgagatacaagtaggtaaagaacctagcacaatgcctaggttgaaaaatgttggtggttgttattacaaacatttctatcaataaagcaatgccacttgtcttgctccagtcccctgaaaggatagttgcatttaatattactccagaccctacaaacgtaactaaaaactatggggactcaatattttctttaacccaattgaagcatcagtgaaatgttttaaatgactccatttaaacattggtacatatttttttttaaaagaaaccactctaaaatggaggcctttcattgatagacacaatgcggttaaacccagtgaaattcgattacctcttgattgggtcgggcaagccaggaagagaattttacatttgaaatcaacaaattgaatttggtaccttttgcagcttcagcaattgctcgccgactagttcctcacaagatcagaggtggccccgtcaacatccaggttctgttgaatgacatgctctgtttagaaaggtttttccttgtttagattctgaatgaatatttgcttccaaagttattacagctacaaaacacatgctgactatacactttccccccaaaatacaaaatatatgaatttatacatatatataattgttgcttaaaagaacttatatataatatataaataaatatgtatgtatttatacacatatatgccttttgcttataagaacttataaagttcttatatataagctcttttaagcaacagttacatatacgtgtgtgtatatatagatacacaaatatatatacacatatgtatatacacgtgtgtttgtgtgtgtgtgtgtatatatatatattttacccagtatggctggtaggctaaatatccagctatacatcatcagtgttaataaggtcttttagtaattttttttgtcttatacagataagcacaattaacaatttctttaagtcaacatgctaagtcagcaatgggcaaaatattgctattcggctgactgcatatttttaaaaatattttattctctccctccccactgtctccaccacacacaaagattgcagacctagtttgtgcatgtcagctgaaggaacaggtgcattggagacatgctgatcctggggtgcagcctggcacctggaaactatcaagcgcagataattgcaacaggtgacatgtgtttttgttttacatatggtttattctaagaagatctttctgatctttgtctcaagattaaagccaaaatctataatttggccacctggccaagaagaccccacaatgggggcccccagctacttttccaccccatcctgcaccaccattccctttcccaccatcttccagttttccaggccacattttattcccccatgtgttacgccctttgcctatacaggagcttggtacgtgttctttcctgttttctaagctttatcgggacataattcacataccatacaatttgcccatttaaactgtacaattctcccatcctccacccagtcctaagcaaacactaacctgcttttgtctccatagatttacctattctaaacactttatagaaatggaatcatagaatatgtggtcttttgtgactagcttctttcactgagcataatgttttcaaggcttatccatattgtagcatgtatcagtactttacttttttgacaaataatattcttttgtatgaataaactacatcttatttattcattcgtcagttaatagacattgcagttgtttctcctgtttggctattatgaataatgctgctgtgaacactcttgtacaagattttgtgtagacaaatgttatcatttctcttgggtatgtatctaggagtggaattgctggaatggagtcatatgataactctatatttaaccacctgaaaaactgccagactgttttccaaagtggctgcatcattttacattctccccagcaaacatgaaagttccaatttctctgcatccttaccaacacttataattccaatcttatactctttctttttatagccaccctagtggatgtgaagtagtatctcattgtgctttctttcttaacttttcatctgggtaattcctattatctttaaatctccagcctaaaagtcacttccatagggaatcttaccttggctaccccaccctcaaactagcctcagattcctctcagaaaacccatcctttctctctaaactttaagttcaacatggacaggcaccattccatctcttctttattccccactctagccccagcatctagctatttatttatttatttatttatttatttatttatttatttatttgagacggagcttggctcttgttgtccaggctgaggtgcaatggcctggttttggctcgctgcaacctctgcctcccgggttcaagtgattctcctgcctcagcctcccgagtagctgggattacaggtgcccgccaccatgtctggctaatttttgtatttttaatagagacgaggtttcaccatgttggtcaggctggtctcgaactcctgacctcaggcagtctgcctgcctcggcctcccaaagtgctgtgattacaggcatgagccaccgcacccggccgcatctggctattatgtgaactataaagttgttgaaagtgtattaagtcaatgccactttttttaaataatgagaaaaagtgtgtattatctgaaaatcacctgtgtcagaataattgacatgattacctttaaatccatttcatttttcagtatttctacagacaaaactattgaggaagattctaatatcactggcaagggtaggaaaggggctctatgatataaccataatgaatgcttctgttgtcctgaattttgttggagctgtacacatttatgtttgttaagaaaaaggatttttgtgggaaagtgcaatatatacaagcaaaaacaaatggacttgagaaataaggaacttaaggggactggattttcctgctttagctgtgagctaagcatacctctagaggtttcaattcagtagatctgagatggggcccaggaatatgcattttaaacatagtccctagtaattctaacgccagtggtccatgagcttcactttaaaaatatatatatcctagttaatgtccttattatttaacataaacaagtcaatgtagaagtttaaaaatcaggctctggagtttgatgcagatttaaacccctggactgacatttactatgtggcttagaacgaattacttaatctttctaagccttagtttctggcccataagaaatgccccaatatgttaattcccattattatgttattaacattattatcttaattggaagatgatgtgcacaacaaatctgttggtttttttttctatttcaacttttattttagatatgggggtacatgtgcaggtgtgttacatgggaatattgcacccaggcagtgagcatagcacccaataagtagcttttcaacccatgtcctcttgcctccctactctagtactccacagtgtctgttgttcccatgtttacgtctgtgtgtgcttcatgtttagctcccactgataagcaagaacatgcatatttggttttctgcccctgccttagtttgcttaggattatggcctccaactccattcatgttactgcaaatgacataatttcattctttttttatagctacatagtattccgtggggtatatgtgccacattttctctatgtaatcaaccattgatgggcacctgagttgattctgtgtctgtgctattgtgagtagcatggccatgaacatgcaagtgcatgggtctttttggtataatgatctattttcctttgggtatatacccagtactgggattgctgggtcaaagagtagctctgttttaagttatttgagaaatctccaaaatgctttccatggtggctaagtgcataagtgttcccttttctctgcagtcttgtcagcatctgttggttttgactttttaagaatagccaccctgactggtgtgagatattatctcatcatggttttgatttgcatttctctgatgattagtgaagatgagtattttttaatatttttttggccacttctatgtcttttttgtttgtttgttttgtttttttgagacggagtttcgctcttgttgcccaggctggagtgcaatggcgcgatctcggctcatcgcaacctccgcctcctaggttcaagtgattctcctgcctcagcctcccgagtagctgggattacaggcatgcgccaccatgcccgtctaattttatatttttagtagagatggggtttctccatgttggtcaggctggtctcgatctcccaacctcaggtgatccaccccgtcttggcctcccaaagtgctgggattacaggcgtgagccaccatgcccagccctatgtctttttttgagaagtgtctacatcttttgctcatttttagtgggggctgttcatttcttgcttgttgatttgtttaagttctttataggttatggatattagacctttgtcagatacataatttgtgaatattttctcccgtcctgtaggtcttttcatagtttattttcctgtgcagaaactcttcagcttaattaggtcccacttaccaatttttgtttttgttgcatttgcttttggggacttagccaaaaattatttgccaaggccaatgttgagaagggcatttcctaggttttcttccaggagtttgaggtcttacatttatatctgtaatccgtcttgagttaatttttttatatggtgaaaggtaagggtccagtttcattcttcttcatatggctagccatttatcccagcaccatgtactgagtagggagttctttttctattgcttgtttttgtcagccttgtcaaagatcagacggttataagtgtatggttttatttctgagttttttatcctgttccattggtctatgtgtctgttttgtactagtaccatgctgttttggttgctctagccttgtggtatagtttgaaattgggtattgtgatgtctccagctttgttccttttgcttaagactgttttggctattcaggctctttttttgggttccatatgaattttagaatagttttttttttaattctgtgaagaatgacattggtagtttgataggaatagaatttaatctgtaagttgctctgggcaatagggctattttagtgatactgattcttccaatccatgaacatggaaagtatttccatttatttgtgtcatctctgatttctttcagcagagttttatagttctccttgtagagatctttcacctccttggttagctgcattcctaggtattttattttctttgtggctatggtaaatgagattgtgctcttgatttgactctcagcctggacattattggtgtatagaaatgctactgatttttgtaccctgattttatatcaaaaacttactaaaattgtttatcagttttagtaggcttttagcagattatttagaattttctagacagaaaattatatcatcagtgaagagagatagtttgacttcttttcctatttggatgccttttatttttttcacttgcctgagcgctctggctaggacatctaacagatccgttttaaagggattgagttttgtttagtaagaaaaatacttcctaagtataagttggaatttatgaggttcgtgaatggctttatcatcactgttacttttatagataattttccaagtggcactttatggtcataaataagcctcagtcatatctttttgcaagtgcctccctaattatcatttctgaagaaaaattttggcctctatattaaattatagttcacgacttagttccagttcacaccctgagctactatattggatataacacatcttccttaggtgttacttactgagctgaaagtattgcccaaagcatcttattttgtctgtatccagtaatttattgagcctggatgctatcctgatagagtttactcactaaaatagaagttataaaagttcaatcaaattatgatctatcagtcatcttacagaaccaagaatgtgcattcatttatccaagtactatttactcagtgcctaaaaaatgtcaggtgtttgggatcacagaaaaaaagaaaaccaagattcccactatcatggagaaatgatattcacagttgagtggtcagtgggactgaaaaaaaaagtaatcaaattcattaccaagacagctttatctgctaatgagtgctacgaatgacattaaatagagtgatgtaatagcaaatgcctaaaggaaaggagctccttttgattaatggcaggaaaaggctctcatctctcaggagatgttgagctgatgtctgaatgccaaggaggcagccatgggaaatgtcagggggcagagtgatttaggaaaagagaacagtcaacaacaagacctggagacaggaccatgtttgtcataactgagaaacagaaagcaggccaatgtagttgaaacagggtgatggaggacagagcagcaggggaggagtctggagatacagttaggggcaccaaggtaaggcctggcgagccctgttaaagagaggaagcactgaagaatttcagcagggggatgtcgttgtctaatttatcatgatttcaggttccctttccccttccttcctcctctctacctaagggtgactagctgttatgataaccagttgaatgatgattagctgcaatattgatttccacatttctagctataatgtctgtaaatttcttaatgaatatgttacataggcatgcactaaaactcccagatcacatcccattttgctttagaagatgtagacacaagtcatgtatttttgtctccattgcatttaaagaatgtctccttaaatctggcaatttaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgtaagtggttttctttttcaaataactttttctgttccttctaatttcttttactaatgcttgaaggactttggagttacctgagccctcgggttaggtgtttgaaaggaaatcacattcttttttatccaaatctctcgaagccacaacaaaaactgatgtctgtcaatctcttgtgctcctgggctgggaaagtatcacccaacttgctagaaacccctctgaaataaatgattagaaatctcatgagatcaaggaaagagcagtgaagcttgctgtagatttatttataattccagcattgtggagttatattataggatgatcatatattaataattgtttagtttgaaaatggagttcttcatctctgtatatctatctatctatgtctttttcctaccaattccttaccctacacctcactttctgttgcctcgtacaatggtccaaggactcatatgagtgaaatcaatatagcccagcatttctaaacataaacacacatacacctagggggacacaaaacctctaagagggtacctaggcatagataattttaaggaaataattttaaatttcaccctttacatgtgcatttgcccaaactctatcttcccgagaatgccctgtatctaaaatattttactgtcatctttcttaatcaactactcccattttagaaaagaaaagtatccttatttaccaactcaagtcttactacacagtacatttacagaatataaaacatttgggacactgaaaaggggaccattgaaatattggtgctggtgttgacaaaagtgattctgatgcctgactaatatacttttttggatataaggaggtttactattttttggctttcaataaaattaaaaactctaatatgcttatcagttgattgatcattaaaaaataattttcggtgacatgttactatgcgatgtgggacatataactcaaaaagaaagtcataaatggtattgctataacaaaactccatttgttttcatttatgcaagcaagctttctcagcatttacatctaaaaaaggaaaaatggaaatgaaatttatgctgaatcatgtactattctataaataaataatgtttatcaaaaaaagtatatattaactgctatggtttgaatacagtttatcccccaccaaaactcatgttgaaagttggtcttcaatgtggcagtgttaggaggcagtgctttttaaagctggttagataactaagatgagttaatgtctttcttgagagactgcattagttctcataagactgtattagttcttgtgagagcaggttgttataaattgagtcagcctcttttgtcttctatcccttttcccacatacccagttcctctttcatttctctgctatgttttgacacagcacaaggccctcaccacaagccaccagatgtggctgtccaatcttaaacttcccagcctgtagactatgtgctaaataaacctcttttctttataaattacccagtctcaggtattgtgttatagccatacaaaatggactaacacagcctattcatctaagaattgtaaattttcaataaaatttttactttttgttttattttattgaggcagagtctcatgccaccacccaggctggcatgcagtggcgtaatcacagctcactccacctcctaggctcagatgatcctcccacctcagcctcccaagtagctgggacaacaggtgcatgccaccacacccagctagtttttgtgttttttgcagagacaaggtttcatcatattttttgcagagacagggtctcaaacttctggactcaggttatcctcccgcctcggcctcccaaagtgctgagattacaggcataagccactctacctggctatttttaaaatttaataattacatattaagtttataacatatttttgttgttttgaaaaattatgcattaataatacttgtagtgatcactcaacccaaaagaaatgtaatacttaaagtcttaggatcacaaataattaaacagttaatttaaatgtgtataaatatttttgttgcaaaaaatatataatagggtaattaataatatgctttccagaaaaaaaaaattatattgtgctataattctgtgagggaagtataataaaaatacaaattcaaggagaacaaaaggaagatgtaaaatttctacctgttaaataacttgttaattataagataatatctgttcattataacagaatatcaagtaactgttccattgatacatttaaaaattgatacaataattttatttttaaatatcaatactttctttttttttttttttttgagacaggatcttactgtcacccaggctgctgtgtagtggagcgatctcggctcacttcaaccttcacctcctgggttcaaatgatcttcccacctcagccccccaagctcccaagtagcagggactataggcgcacaccaccacactcagctaattttttgtattttttggtacagacaggattttaccatgttgcccaggctggtcttgagctcctggactcaagcaatctagcagccttggcctcccaaaatgttgggattacaggcgtgagccaccatgcccagcctaatacatttaatatgccagaaattactttatttgcaactgtttgaactttcaataaaaacaaaattagatgccaactttatacaagtagggacatagtttttaaaaattattttagggagtatgtgagtaaaataaatttcacaaatccctattatagagatctgaaccttaaaacaataaattttgaaggataactgggagaattctctgtttttagaaatttgttaagtttgaaaggactagaaaatgttcaggtgtgcaacactttaatatgttaacttaaaaaaagagtaacaaaacagaatttgaaactttgggcaagtgtttttttttttttctatctcaaatttcagttaatagtctaaatgatttcaaaatatctttaacagagtcaccaaacttgggcttatccccaccatgatgtacagatggacatacctaagagattgtaatgcatataccataaatccagcatgcatgtttatttctggatccatgtaaacatgctcacaggacttttaagcctgaggaaatatcctgacttctaaacagaaaaagttgatacagctaatccacacataaagtgggaaaaaaactatttcgttatataaaaccacattctactcatataaaatgatcttgtaaaggcatgctgctttatctctgtgtaaacagtctttcccatcaagcaagatatgatgaaatcctgaattgtataatacaatggtaggttttgtttcattatgtcgtgggaggaaggaacagagagagataattctagtaatcaaaaaagaaaagtctcctagatgaaacttctttaatattaaaaaactgaagtgctcattacttggcagataaagttaatttaaagatgagcctgaatcataggagtcacagaggcagattgcatgtagatcagcaggatgccattataactgcaaagagcaaaccacatcgattcaaatcccaccatgatgaagctgtgattggggaagtaaggggtgctatgacaccatttgtgaagagcaggtttaagcgaattcacagtaggagcaaggtctcaagagggtagtgcctacttaagaaaactttcaaatactagaaaagcatttgttcaagtgttcacaataattttgcttgtttaaaacccatcctctttattcacaaagatggctactgtattagtccattctcacactgctttaaagaatggcctgagattaggtaatttctaaagaaaagaggtttaattaactcacagttccgtatggctggggaggcctcaggaaatttacgatcatggtggaaggcacctcttcatagggcagacaaagagagaagaagtgagcaagtgaggaactaccaaacacttataaaaccgtcagatctcatgagaactcactcactatcatgagaacagcagggggggaaccacccccatgatccaatcacctcccaccaggtctctccctcaagacctggggattacaattcaagatgagatttgggtggggacacaaagcctaaccatatcaactactgatcattatttgggcaacttcattttggttgccatctattttttgtcattattttgtttctaaccaaacacacactttaaaaaaaatttatgtaatttgtgattcttcaagtcaaactttgaacatgaaactacaaaattgctgtatcaggtgaacataaactaattcaagcagtttaagaaatccgatacccttccaaggtagttcacatccaaaaaattaacaaattttcatctcaatttatagtcctctgggacatgacattatacatcctgcacaaataaagttaatgttgtagggaagtgacaaggacgataataacaataacatcaaccgatattgattgggtttctactatgtgatgagctaatttaatactcaagacaaccctagtttatattattattcacatttatagatgagagaagggaagcttagagcagttaccaactctctctccctggttgcatcacttataggcagaaggttcagagtgtgggttgaaatccagagctcaattcataatcaccatgcaagaggcccaagatcctgatagccaatgtgctacagaagttagagaggtggagataggtaagacaaattggtattgttttactctagaagcaaataaatcaagctcataatccctaggctcttttgctcatttgactgtcatagaggattttattttatttgcctccagaatccatctggagatatggaatgacagccatgcatctgtcgtactagaactactagagggttctgcttctaagtgccatttatctgacttgcaaatagaagataccaatgagagaaaacaaattttaaaatggccaggataaatgtgtattgtgaatcacagattaccaggatttgttcctatgcatttccaagcagttgtgagcaatttcagacagacttgagccaagtttatcaatggctactgaaaaaattttttctactgaatatgtatgacaagattgcccacctttaagtaaaaatgagaatctgaatgcctttagaagtaacacaattgttaatgatgctgaatgatataatagttagaaaattgggccaaagaaatcagccagctactgtatgtcactacagtaagtgtcttcatgtacagataaataaatatcagctctcagaaagcagaaatgtccgtgtgaatggtgcataattgtgaaattgaaatgtcatatcaggttatatcattttgtcatgttccttatagttttaaaagccaatctcctgcctaggttactgtgacaggatgttctgagccattttcagatctcaagtcaaataatgaggatttagttttcttccaatattaatgtaaagcagatttttaaaagcaacttatcttacaagactgacagaatgcttgaatgctctaagaatgagtacattaataaataccatctcatgtttcagtgaatctgtattgcaagacgtttggcttaaaataacttctctgggaattaggaagaagcttgatatccaccttaagattttgtgtaaaagacagaggctatgttattcaaactctcctcccataaaggagaccaggttgacccaaggcagtttatgggaccaggagtgtttactgatggcaggcaaacagtggtatcacggctcaccttggtttcatgaccagtgccttccaaatattttcctatttccccatctagcctcaaaacaatcctgggagagacgtagtgcaatgagaattaaccctattctacagattcaatttaattcctctttagtgagcgctagacattggaaaataagtccaggatattagaaaccttgcttgtatcagagaagaagttaatagcagaacaaagacacaaactcttagtccagtgatcttcagggtagtggctaatttatggggtgctggattttaatcttcttgtgtgaaatattatttaacaggtggaagctgttacttcacgtatagaatagtgttaataataatgtgcacatcacatgagtgcagtaaggaaaggaagagttaatgcctgaaaagcactttacacagggaaaggcacacagtaagtgataaattaatggtatctgattgtagcactattattatcattaattttaattattctcctgtccattactgggtagttccttagtcccacaaaggaaaattggaggcactttcctttgattgactgctgctttcacagttctgtcttcctccagtccttctatcccatgcaccttcttatccccaagtcgccaaggatagagcttaactcaggactacttgtaagatcacaattgctaggttgaaccatccaattaacctttgtgtttcttgaatcccactccattagatgactgggaggtagactttaaatttccccaaacaaaataaggtttcttgttttgaactacaggctggggccatcactaagggaagaaaataacaaagagatatggagctggatgctcaaataatcaaatgctctttcccaccagctacacctttgtttgagtataattagatacagaaatcagattttgcagtctctgagctatacagaaattgctgagaaagtgctctctcttctccccttccctctctccctctccccaattcccctctgtcttcttctcctttcctcttctctcctcttttctctccccattctcctctctcctgtttatgtcagttccatttcatgtctattttattttaataggtaataagtgtcttcaacaggccaagaaacatgtatttatgggtgaattaaaagcatttagtctgctgaggaacattattgaatcattaaatcattataactctcctacaaatggcttgctaggggtatgtagacaggctttggtaacctagaggaggaggtgcataatcttgcctagaagtgagggcatgcccttttcaggtctctgtgctgtggacttgtcataaagtataataaaaaaataaaaaataaaaataaaaacaaatatttactgctagaaaactcctataaactgcattttaataaatactctcaaatatggaaaaaaaaaaaaaaaagacaactcgagagcatcttgaggttggtgagcaaggcaaatgaaggaccttgtttttgaagttctaccccaggaacagtgtatttgatgataaacataatatcatttgaagccccaaaagtgtgtatgtatgttgttagtcatagacacacctatcagaatctgacactgatttgtggggtgggtggggtgtgtgtgtgtctttctttttttttttttttgagacagagtcttgctctgtcatccagcctggagtgcagtggcacagtcgatctcggctcactgcaaccactgcctcctggattcaagccattctcctgcctcagcctccccagtagctgagattacaggggtgcaccaccatgcccagctaatttttgtatttttagtagagacggggtttcaccatgttggccaggctggtcccaaactcctgaccttgcgatccacctgcctcagcctcccaaagtgctgggattgcaggtgtgagccaccgtgcccagccggtgtgtgtgtgtgtgtgtgtgtctcacctcctcactctctgagataagaagtgtcgataatgcaaaaatgtatggacttcaccttaaatgaactcataatctaaaccactataaattttgcatcaagtacatttctctcagaattggcagcacagatgaaggcaaatacattaatccattcaaaattttcccggtgtgctttctagatgttttatcggatctcacatcctcagctctttttcagctttttaacgattagtgaattcttaattacaatttaaatgaaggttcattcccactgtatttggtaccacatttctcgaattagctactttaataaaaagatgagctgtagttctgtagccttaataaaggcagtgaactgcttaaagaattcatgcttcttccagagcccacagcttttcttgtcctttgctggagtctgtgcctttggtgggctggtggaaaatgtctgtcccaaccccatccacgtttgtcacatttccttacattccagggaattcctcattcagttagaaaatcaagatcttgcagaaacttagcaaagccccagtgtgtctttcctatatgttttctttttcatttaaaacaaaatgaaatgtgaaatgtttctactccatagcctggcatacccagagaaaacttggcttcctttctcagacagaccaggggttttcaactcctgtcctatggagagggaggagggaggtgacaattttgcccctgactcaaccccctgccgctgtcttaagtttgtcttgctacaataaaatacctgagactgggtaatttttaaagaacagaaattaatcttctcacagttctggaggctggaaagtccaagatcaagtttccagcaggttctattgcttggtgagggctgccctctgcctccaagatggtgcgttgttgcagcatcgtctggaaggatggaatactgcgtcctcacgtggtagaaggcagaagagaaacggagcagaacatgtgggaagcctcttttaaaaaggccttaatcccattcatgagggaggggccctcatggtctaatgacctcttaagtgccctacttcttaatattatcacattgacaacacaaggcttttcaagaggacaaattcaaatcctagcattctgcccatgacccccaatatccatgtgttgccatgtgaggacacagcattcctccctttcagaggatgctgcaatgaggcaccatcttggaggttacctgtcctagaggcaattcaggtccacttgactttagcttagacgttgcttcatttttctctgaataattctacttatggggaactctctacctgtcaccgtgttcattcctctgggtccaggaacctcactgctagcttttggctgtcatattgtcttctatcctcttgtgtcccctctcttagctacctccaacacacacacaaacacactcttcagcccaacctaaacatttcagcttcatagtctctttcctctaagctctgctttctgatctagctgacatcctagagagaaaaatgctgtcaacctcatttccctatccagttttagatgttactcatcaaagaactcttgcgtttttctagaatacttcaggagcatttatattgctcctgactccatatctaattatggaatttgagccaattaaatatttcctagcaacttgggcactagtttaacttttacggctaccacaagtaattttggtagactcccaaagtggtaaagatctgggaaaaatgggagtaaaaatattttactatttaaagaacaactatccataattatttttgctaattcatcttgtattgatttttccttgtgtgccctcagatactgctgggttttactttttgtttttcaatgaaacaaaatttcatgttatgtttcctttttgatggtgaggtaaagctctttttcagattcaagaataatgatcatggctgtgtaggcctcactggatcccagaccctcttacagtcgctagggacatgaagtcaaataaaacctaggtcctagcctcaaactacctgctttattcctattacccttgagggcaaaatctgtgatggggagacattagcagggaggggttataattttgggctctggactcagactgcctgggcccaaatctcagtaccaccatctaccatctgtatgactttggactgatggttatagaacctctctatacttctgagtcttcatctatcaaatgaagagactaacgtttcctaatttataaagtagttggtcagagtaaatgggttattacccataaagccactagaacaacaccaggcactcagcaggtgctaactaatgcaagccattatttttatcagctttatgattatctaccatcatatccatactctgctttctctgtaactggtgttgattaaatctcattggactgatcagctgaaacacaagtggatgggtacacactctattgactttctcatcttgagaaatgcttggaaggcttcttattgtcctgtttacatcaaatgttcttctatattattttttgttctctgagcctcccaactcagcataagctgctgtcattatagacaaatgcaatcagccctaatgtatagcttcactcttttccccatcactctgttcccctcccttcagctatcccactaccactctggcactcagatctcatggtttagggaaagaggggagagagcactaccccattaaatcagccaaccagcctccagagaacagaagtttgaatctctcaccagctggcaagtctgaaaaaaagtggaagggtgtaaagaacacaatagcgtaacaggatgaaacttggaaatttgattggggcatccagctgagaaactagtctcagactttcatcctcctatcattttttgaaagttgtgagatcttcccctccccatcccccaagatggcaaacatccttactagttgctgaatttatttccttgaatccagaacaagcacacactcacacacacagctttagcttcattggggtctcagcagcttaagaatgtcttgctctaatactcacagttcattagactttcaaacagttggcacaaagttagccctttccgcagggggacatcttcatttccattgctgattagcaggatcctaatcaaagttacagatgcatgcaaagaaatgcttcagaatttgccctgggaacaggtaggaagagatagcaggtaaaactgatctgaatcccttatgagggacaaggttattgaaaacacttgagtgattggccaaggagtgatcgcacctttgttccaccacctgtctgagatctgcaacttagaatgctcttccacgttgttctcaaatatctaagaaacatctaatcaatttatatgctatctcaagaaatagacagctaagcttgaattgcaatgagtttcttatttgtggcctattggcccactagccaattggctagttaccattatgggcagaaaataatgtagactattgacaatctagaaattgcaagactgaaaaaagtgaaattattaccatggaaaaaagaacttagaaaaaagtgcagttgaggctagggaaaagtgaggttaaatgccattgagctgccacttactccacaggccaagaattaaataaaatagaagttatattggttaattctccaaataccattaaggcacttattgttattcccattttacagatgttgaatccaatttacagaggttaagtaatttaaatagtgctgtatattgagtgtgatccagagacatgctcttcaccacagtgctgtattgccaccccattttttacctggaagtggagaaaaaagccaagaatatctattagcttattgagcatctgctgtgcacaagacaggtgggggacacagtagcaagacatacacaagtcccttctttgggagaaccaccctctcccacttatatagtcctggcggatggtcaatcatggtgcctcacttgatacctataaggtcaagtgactcaagccaggaatcaaagtcccctcttgaatttctctatgaagtgaatttcttatttctatggagttactaagctaggtatatgtgggcctagttgatagtgaccacattgcccatgatgtagaaggagtctatttaaagaataaagctgggcagagacaagcagatcctcaaggggagagaaaaagatagagggagagagaaaggcttaccaagaagaaattgaggccctgaattcagccacagctgaagccagcacattctagactttccggttgtcagtggctgaatttcctcatgtgattgctggtttgatttaggtttctgatactcgccaaataatcctgacctaaataatttctatctcttctgtaaaatgttataagcacctatgcatcaaaatagtattaatggagattaaataacaaatgtctagtgtaatggttaggtgttaagcagatggtagatgcttagtaacagtttatttatctattcataggaccaagaaagagtaagacgaagtaactctactagtatttttatattcagtattatttaactctgtttccctttgtaatgactgcataatattccattatattgagataaaatgaattatttcaccaatctcttattgttggacttcgaattttacatggctttgaatttttctctctcataagcaattagccttgcactttacacatattttaaattatttccttaagataaaaacccagaagttgattatcttcctgattttgaaggcagaagtttctaattttttccacattaaatacatccctaacctgtgacctcttatctgagtgaaaattttgaattccaacttttgactacaccccaggccctgaaatcttatgctgttgtagaagagatctcccaaaaaagacctacaaagataattttcttcccagagaataaaaaaactaaaataaaaataacttgttctaaggagcctgacattaaaacatttgctttgaaacttgagatactaaggaaacatcacaaattaaattcaagctgtgtttaagtacgcagaagtcaggctttaattatcagggagaaatccccaagacaggcatgaatttgcatagccacgcaagcgtaggcccagtgctgggctctgcatgccctcagctttggcagtatcctttctcattgagactcaaaaagtgaagttcaaaaccattaacagctcctctggccaaaaatggaagaaaaaacaaacatacagaaatcccatgtgatttttttttagcataatggaattctttataagttgcatcctggggtatctgcaatgcccgcagttctgtatgtggcaacccagcagatggtcagggagcagcaaaagtggtaatagtctatccaactctgcctgctgcagtcggccttggggagcttctaaataaatctggtggctcctttcaaacccaaagttaagccatcttccgcagctttcattggctttgtttgtttgtttgtttgtttcactcattctgtaaatagttgattcaagattgaaaaaactaagaccaaactacatgggatttgtgttcctgattagaagatatagctggtagaaggctgattctgggctttatgaaaccctcatgcattaagagttggcacacttaggggaacagggcgggtgagggggccagggaaaggaaagaattgatgacattagggcatattcatggacactccctgtggaatggtctccgacctccagtcttccattcttccaatctgttatttcaaatagagctgtgtttacaccattgtatctctggcttatagaaataaaacgtctctcctcacatcagcattcaaggccctcctaagcgttcacatgctcttcagagctatctcccgtcatccccggtattccatgttttagtcaaactgtacaatttgccattccctaatcacactgtaaaaattcctattctgcatagctactgagctgctacctgccacctggaaggtcctcctcccttctccctcccagcctatcaaaattcaactcatcttcaaagacccatctcacaggctatctgttccacgaagtatttcttcactacccatgtccttatccccaaagatatgtgatttctccctcttctaaacctcccagctctgtgtaaaaatcattctttgtgcaaatccattattaccttgcactttcattggatgtggttttgtctgatcccccctgctagatatcaaatatctgaaggacaaggattatttccaacacagctattgtcccctaaaggcagtatttaaaatgaaattaatgatcttcatcaaggatagggtctgagtttgctcatctactcaacacacatttgttgggttcctgaaaatatatattctaagggaaacatagaaacatataaaagaaccccccaaaatatagactacgcactctccaacatctgggtctataatattggaggtacccatcatgactgttacagtttaacatcagggttttgaaaatcacaataagcatcaatgttatcaagaccacgcctcatctcagaagagactcagcttgctattttaaaatggtggagtctaattcttctcaaatactcccttccacatgcgtactaaaatgtatgggaaatctacctaaccatgggatcttaaagttttactgttgtgcactttgttctcattaatcattttgtaagaggaaaatgaaattaaaaatagtatacctgctgtccctgcagtctttgttcctctctgaaaaggtggaatttggccttacttttgcctttctctttaaaataggtattaatcattgtgttttttcaaggcaaattcaaatttataaacttccaaaacatcctttcagtcactggttactaacgcttatctgttttctggttgagggaggttacttgataaataggtaatccgaaaactagagatttactcttgaataacagccaaccttttaaagactcagttatgaattaccctcaaagagaaggaaggaattagtaatattctgtattcaaaattcagaaaatttctaaatgctcataaaaagacagtatttcttttctaccacgtggaataaaagaaagctaattcacccagactttatactcttgcttatataaagtaatttgattgatatataataatttgatgatacatgaacgtattcctaaggtgcttagtgttaagtaaaactaatgaaatttttccagaagaaaaaaattgtctggctggacaaaggtgaccccgcctagatctatgatcctaggacaatgccaccctttcagtttcctgcttagacatcagtttcctgtccagcaaaatgagctcgttgaaggtaggactggttttgctatccctgaagaaccagctctaagcaggacagagcccaacacagagcagacattcagtaagtgcttatcaaaggaatgaactccaagctccaatgtgtgtgtacatggctctttaactaaaattcaaaccctcacatccacttgactttcagtccaaagcaaccatacatctgtgtgagtgttcttcttgggtgtcctgggacagcaaaacaagtggcactttcagttgtgatttaactcgaaatctttctaattgagtcttgctacctactaaatcaaattgttccaaaggcctccattttcaccaaaattccacctttaactgtgctttcttctccttctcctcctcctcctcctccttcctcttcttattcttattcttcttctttttgtatgctctctgaactatctcttttgctatgagattattcaaagtcttctgtcctgtctaaagcattgttcttgcaacaaggatccaacacctgctgactctgagtaaggcattatgctaggtatagtcgcctaagcctgagtctctctatcctcgcttgccctctcattttaaagtttatctctccaaaacagaaatactttcccttcccaaagctcttgaattagggaaagaggtcagaaattaaatgctgtctcatcactcttgtttagaagtatagaatctttattggtttgtgaaagtggaaaataataactctttttgccatttaaaattgaacaacagctaagtagaagtgacaggatagatttaaattagaaaggttctattaaatcaaccgaagtcaaagccgatttcactccaggaactgtatgcataaaaaggtgtaattatgaaaacttgatattctgctactttatgcatattcactttatgaacttagacctccagaagcctcctagactgctttctcatttttaataagtattagaataaggcatgccctgatgggattaaaggagggaggaggtttgtgtgtgtgtgtgtgatttttttcctcccttagtttagcagtaatattaagacaaaaatgtagctattctgctgggttttgtgtgtgttttaagagtgttgcaaataaaatgaacctcagggagtcagcaaagaaattatagttttccaattagggggacaacggatccatcagggaaaatatcttattaattgcagcttctaaagaacatgaatgagtctctctgaagtcactgagaatatttatctttgtaaaaggagagaatttcagagaattaccagaagatttagtaatctaaaacccagggctatcagttgggtcatgtttccatcaacagaacatcatagtggacaacgcaggtgaagggacaattgagaattagctcaaactgagcagctaacttgcacctgtccattctacatgggagccaacctcagaacattgtgaggtttcatcacactcaagataagaagtctattaaggaaagatgtcaagaccgttaagaggctgatttttgtactccattttctcccatctccaaaataaatattaatgctgcggcccctcaatttcttgaagctttaaggatataatactagagtgaaagggatcagaatgaatgctgggagcagctttgaagtcatcatcactttctacgtcctccctctgttttatcagtggaagcctagagaagttatcaattgccaaagtcacacagttggttcactgaacccttcattatttctcaggatgtccaagaaacaccatcatgtagttcaggtccatcttgccagttagttctgccatctcattgttctatgtcaacctggttcaggacagaggatgtgtgaaaggaatgtgtgggttgtgttgtgaattttcttgtcatcatttacataaatacaaaagccaacttggggacaggatgccgccgccaaattgagtcagatttaatgagcttttgcaaagaatatttatttctaagacattctaaatttcaagctaccaggtgggcccactggtgggtaaaagccattagctgaatgtcagggcttcttttccacccttagaatctggactcttttctttccctgctgtggatgatggaatctaaaatatttatgtggctttataatgactatttaacatttacaggcacctggtatttgccaaaatgcttgacagtcagtgtttactaacaggaaagtaactactagaaaatctgccctgtaatatttggggagcaagtccctttgaagctagagagagtgttttggggaacaatattcaggccaatgatacagagtgaaatttatttcccacattttgcctgtggcctcacatttaaactttcccatagtttactaaacttcattccaaaaatcctgacaggtagcgtgattactatgtgttgcatttattcatcaagcatttagtaagcatcaactagatgttgaggatgaaggattaataaaactccacccaagtatgggttaagtgctcttcccatgatgccttgtgtctagccataagagaatgagtaattctcagtggtgaagtgggggcaaagtgaggagaagtggaatctggcaatgggatactgctaaacatcccatgaggcaaaggatactctaaaacaacaatgaattatctggtccaaaatgtcaatagtgccgaggtgggaaaaccatactgtaagcccatctttctggtttatacttgttggttacatatcagcctctaccaccatatcataagatctttgagtgcagagatcttatcttattcttcactgtatcccagcacacaacacatatacagaactcaatacatagtgttgaatgaattaatgaaggtggtgtcctatccctcagggaacccacaatctcaggggtagagatagatagataagcaggcaatttaaggataaaatgtgttcagtcttcaaagtacagtcagataaaagctatttttctgtgactttataatttatcatccaagtagataaatttttgaaagtgtgggcgagcactttcaaataattaagtcagggccatgagtgaatccctgtaacaggcctctcccacatacacatgactgtgtatgtgccacataagggcacacacacagtcaaacctacctatatagcccacatgttcctaagcacccgcattgaagcaggtgcaagcacttcacagaatccacccccacaagcatgagctgagtattagatgtatagcagagttaacaggacccagaaaagttgacattgcgtgttacacagcaaaaagttaatgaaaagaaataaatagaagcttattaaatgacttgttctttattccaggccctcgtttcatacccaccctctgccaacagcaattttctcctctgcttcttgaacctcttcctaccagcctctctggccttccagatttttcttcttccatgatcccctgttcctctttctcatcataaagatgtggcacactctcagctcctattcccacatccattagcccccctcagtcaccaaggggtctccctgcttaggaaccaattagagattgtaaataaaaataacttttcccagatacgcttctcatggctccaagctgtagtgaaggtttcttcaatgcagtggctgggattgtggggaaaagctttatagagaaaataatattccaacagactctgcttactcagagaaaatgtcagtttactcaaaggaaatttaatcaaaaaaacatggaaaatcacaaaaggtctggacctcatgttttctcagtggatagaaagagttgccttcaccaggagcatactttgttaggggtcggaaacaaagatctcaagtggaaacttgcgaaagggtgaagtgaataagaagagtgtggtttatggcttttccaagcctacacactttggaagaaagatactgaggcttcacattaactttttccttttatgctaaactctatttcagtaaaaactaaaccaactgtttataatctttaatgcagttattgtgcaaataaacatttcttcatgatccaagtgtcatttttttattatgagcaaatactagagacaataaagttactatctttaactttaggtagaataacttccttcattttgtagtcccttctgacactacagctacaaagaaatccccaaatgacactgtaatatactgtgctttcttttactagattttaaaaagaccctccttgacacaagatcagcagcgtccatcatccctgtatagcctttgagatttcacaactttgtatgtgaggttgatatcaagttaacctgtcagaataaaatgttacttggtatttaacatattctattccaattggcttcctctgagtacgtgaaacaaataccaaatgataatttatatgagcacaagagaattgttgctaattttagaaagttcctagccatttccctcacccaaagttagcaaaggaattcccagttggaatgactttccaagtttttcttaaaactgtatcatcattgttcttaacagtatgtcaagccagtccacagttttccatgcatagaaaacacgttatctggggctgggcgcggtgactcacacctgtaatcccaacactttgggaggctgaggcaggcggatcacgaggtcaggagatcgagaacatcctggctaatatggtgaaaccccgtctctactaaaaatacaaaaaattagctgggcatggtagcacgtgcctgtagtcccagctactcgggaagttgaggcaggagaatcacttgaacccaggagctggaggttgcagtgagctgagattgcacaactacactccagcctgggcaacagagcaagaatacgtctcaaaaaaaaaaaaaagaaagaaagaaaaagaaaaagaaaaaagaaaacatgttatctaagccttcttcccaatcattagtaaacatgttgaccaggacaaaggtggacctcagaaacctgtgatccttgaagagccatttgcacattcactctacccctacaggatacatttttttttaacctagtcaaactggctgaaccagtttttaatctctggtctatactgtgagggggcaaatctcactgaaaagattcattagtgacagctaaatgtaaggtgtagcgatgaaaggactgggcagatctgggcctgttggcaatctgaaaaacagatggctatgcaaatacaattctcagactcagttgtaaggtaaactgtgaaccagggagcagcatgtggctgggtaaacgcaatgcttaaatgctgtctgcatgtttacattcagatcttagaaactgaaatcttcctaattgaattcaacaaacaattgaattgagaaatgatttatgtgcaaaatactgcgctaggccctgaggcccagagaaagttgaattatagagtaccctgaatttagggatatttggttcaccaagacccacatggagaggaaagccaatagctatatatgaagaaaggacaaggaattgaattgattccaaccagagcaacttgggaactgtttttttggaagggagggacaggagaaggtcaaatgtgagaaaaaaatgtgggcttctaggggcaaatacagtggggagctttttctgtgagaagagaactagagtaatggatcagaaacaggagagggaagaggtcgtgtgtaggtgtatgaatgtaggtatgtgtgagtgggggtatgtgaatgcttgtgaagctgagtaaattatttaaagttggaggacttagtaagaaataaagctattaaaagtaggatgggcctaattgtagtgcatggatacattctgtaaaggatttctcacccctcctcaaaaaagtacgtgtttccaaggcatgatgaattctaagtcacttatgtatacaactggaagggttacgtaggagacgggtattagcaagcctgcgtttttaaaagcttttgttaacaattaaataatctgctggtaatagaggcaaggagggggatgtttattacgaggtaatggcaacagattagagagagcaatagagtctaatcacaatgtgaactctttcttgaaggcttactacatgacagacacaaactaagtgcttcacatgcactatgtcatttaaaagtcacagaactcctagaagcgaagtgtttttattcccattgcaagtaaggcccaagatgtgtgcaatccaaggctcaagctgggaatcaccacctcctgtcttcccttgggatagtgtaaggtggtgattaccagcgtaggtcctggacctcacagttctcacttcacttctggctcaaccatttacaagccatgttacttaccttgggcctcacttgaaataggtagggaggaggtgctaaagaaggctgttggcaattcagcatgtggcatgagattttgtcatcagccaagctgatacatgcaggtgaagaagtaggtgtaaggagagagtgagttaggtttagacaagtcaaatcaaaggagcataggtcttccatgtgtggatagtagcaaagagttgaggggtggatctgaaattctcgtgagggataagaacaggaagagagaggaggtgtgagagtggaagctatgacttcaagactcatattttacggataaatagaaaaagggctctcaaagacaactttcatgaacttaatagctggcaatactgaccatcagatctcccatctaaaagattttgaaatgagtaaatggaggttttccttaaccatccctaaccaaagagaaagacagtggtagttttttcttctgtataattttaacaaggtaaatagagcccagaacctgtatctcaatgaaatagccatccaagagcctgacttgcctgcatggcagaacttgtagagttcagcaaggcagatacacccagccaatatgctcaactggtagagtttgctttgctaggaatcctggaatcacacattctcagagttgggcccccaactaccatcttcccagccagaaacctgggtgtttcctatgacacttcctctacacccttaaatcaaatcccccactaaactccattaaatccatcttcttatctcttccttgagtccagctgccacttccctaatccagactgttgtcacctctcgtttaaagttcaactgcaatttcctactggttttctccttccctcaaatccaatttccatggggcaatatatgtatatttgttatcacatcctttaaggatctcttaaaggtgaagaaccgctgttcaaacccattttaggcaaataaattaaggtcttcatttcctaggttgataaacttaccaggcttgctcccatctcaggggctccctgcctccccttccttctgcctggaaggctcttccccagatattcacatggctggctcccatattttcttcaagtgtttatgcaaaacccaccttctcaataaagtttccctggccacctcatctagaacttcagcacccatttccccaacatacttcacttttatctttctttcctgaattatcgtttctccaaaatatttaccactatccaaactaccacatacttcactaatttaccttgttcattgtctgtcccctacacaagaacatatatttggcaagggcaggggtttgtgtctgcttttgtccaagactatatttccagtgtttagaaagatgctcaacatgaggtgcaaagtgaatgatcaatgatgtttattgactttttgttgtttctgttggtgtttttatatggtcctggattatctggctaattttcccagttctcatttaaagtgaataagtaatttcaaatggtttctgaggttggttcctcatatttaactaaaacacacacacacacacacacacacacacacacacacgcacacacacacaaatatgctgttatctgtcattttaagaaagaacactctagtgtttctccttagtcttgaatgccaagtattagggggcaaaatggggggaggactgttcattttaaaaatattaaaaatgaattatgaattttcatttgaaagattttctcattcatgcttataaatagccattatatgacccaattgagctaggaggtctctaatagctaaggagaaattcatcctcgcagccatttcatattgagaaccaaagaagttggtgaatattagaaaaaagaaatccctgtattcatcacttttttatgagcaaagttcatcaaaaccactgtagaatagaactcagagttttgagaaagtcctgttagtcttgcagaaaatgtatgtttattgataatactcaggtgatttagcaaacacaacagtatctgtgggaatgattgcgttcctttgccaaaatgcacagaattaagtgccctggggcaaataaaaatgtgactcagaaaaatactttaaaaactattctttcctcatagcaatacaaatccaaagtcaggcatgacctgtggggagttaaatggcaatgtagacttcagaataaggtagagataataccaacaaaagccagacccatgatgcagtacaagtgtctcaagggagacattcagctgggtagctattgtgtagtctccaggacgtggaagcattaacctaatatgaacatcagccttttttaacacagtgccaagctagtcagatacagatacagttcccagttagtgagtctctggttatgaaacctagtgtatttttccaattgtggtcaaatgggttggcattcagcatgcatggtctcatttccagaaaggcttcacttctgtcactcgtgatctgctttgggaattcatccttgacaagttagtctccttatacagttctggcaaattagtctcattatacagttctggcctgtggtaactacatctggaaataacgttaacggtttacatatattgtgtatttaccatatgtcaggcatataatgaatgtttcatatgttacatgtcatttaatcttcacaacagttttgtgaggtaggtagtattgcccatttcacagatttggaaaataaagcataggcggtatagggatcttggctaaagccatacaatgagtcagtgaagatgaatccagaactgacttcagaactgtaacaattaacccctgtactctacactctactgcctttgtaaagaatgaaaagtgaagagacagagaaatggtaaagaaaggatccctcaggggtgttttccaccactgtcctgaacacaatcagaaaagctccatactaaatcagaaaaacaaactcaaccagtctctgttccaaagcgatacttcataaactgcatcaagggagcactgcgttgagaaccattaccttgaaacccttcgggaaggttggtggaggagggaggttgtatgttggggacaggggtaggtggttgtagcactaaagcaacaccaaacaaaagaaagttcctgctcattccaaatcagtaacagtaacatagtagattgcattgtatagtcatcagtcatacaatcattcaaaaacatgcatttatcaaaacgtaaagcaaacaaacaaacacacgcacacataagaaagatgctgagaaagaaaatgaagcatttccaacctacaggcaacctgccatctcatcaaaaagcataagcacgagtatgcgtccatctcagctccctcatgatccccacagtgagagctctttctgaactgaagcaattccagtgttcaaagatatgtatttttgtacaacacggtcctaaatacaaaccaacacctttatgcatgcacaaaagcaagggcaccactcactccaggagacttgaaaggtttattaaagtttactttgactcttgctggttttcttattacaaaaaaaaaaattaaaactcatctcccctcatgtatgattgaactctcccatatttccaacacattttaaaaggttattgtgatttcaagtgtggatttctttttaacttaagctagacacaattactttaacaggtaccataatttggctttcacattctctcaaaatcatcaaaacagtacttgcaaaatgtttgcttcccaggtgttttccaatagattcaatactatttgccatggtgcataaactgaatgagagtggtctgtgaaatacggaatcaagatgttgcatacttacctccagaattgagtgcggctttggtttgtgctctggaaaacactttctatttggcttcattttagtaacagtgaaaaagatcaaaaactggaataatattatgagaagcacttaacgggggagctctgaaaactggtagaagattattacttctttagctaagttctgcaaatttgtggggaatcaggggtcctctttatgagtaagaatatcttatgaagaaccttcgctttttttagtagctaattcctttttctcatcaacaggacacaatatggcatataatcagatttcatcataacagattttaatataccatagatcatatggtgtccccatagcataactactcatgaccagattctaataatatgcaaatttagctaagtgcatattattggacttttgtctgataatgttggtcttgatccgctgatattcagctccatggtttcattaagcagtcaattaggaaaaaagagaaaagcagcatatatgtatttcttctttattttggtaaaggatttttactttatctgcttatattgataagatatgacacaggaataggtgctacaggatttacaaaaatacatttgacacagtcacagtaaggcataatctcagcaaatccttaatggttagggacccaggctctggaatcggactgcatttgtgccccggttctaccacttactagctggttaaccctggataatttactaaacctctctgtgcctctgtattttcacctgttcattgatgataataatagtacctatcctatcactgagaatttgatgagattagctcatgtaagtgtcacgcgtgtccgtatagaagaccacctaaacaggctttgtgtgagcaacaaggctgttgattcacttgggtgcatgtgggctgagtccaaaaagaagtcagcgaggggagacaggaaaggggcagctttataggactggggtaggcagtggaaagttacagactgaggtggttatctattgttagcagagaaggtcacaaagtgcatggtggggagatcataagactcattgtccagaagaagaatgtcacaaggtcagttgatcagttggggcagggcaggaacaagtcataatggtggaatgtcataaggttggtcaatcagttaaggcaggagatggctgtttcacttcttctgtggtttttcagctgctccagacttcttggctcctgtaggccatgtggacatatatgtgcaggccacaggggttacaatggctgagctttggctaagaggcctgacattcctgtctttttatttataaaatataaggttataagaaaagataaagaaaatataagtttcttctggggattattggggtagaggcgatgtttctcaggactgcttcaagcgtgaccagggactgtgtggacatcttaaagaaaattttataatgagttagtccagtaagtttcgggtctagggtgcatttttatgtagctaacaaggtgccagttggcatatttttgagcttggaactgccctaataaaataagttctctaaaaacagtaatcaggcatattagcttttaatgtaggcggagatgagtttttaggccaaggaaggaataatgttttacgtaccaaaggctttcatccccattttccaacatatgaataggattccctgttgttaagtcaatgatctattatattacccttttcccataggtgtgagtggtggtctgattggaaaagctcaatagttctgactgcagatcctattcaggagagataataagtaaaagaatctttgtctcctggattaaggtgaggaagaatgaattttccatgatctaagaaccacttgccctgggttggaaaagactggtagagcaggcttacagaggaggagtagatgggggtgatagaggagaaagaaaaatactggccttttggagtgagggctggaatatttgcgggtgtggaggcatttgctatttcttttgctgtcctgtcggcataggcatttcctttagcaatgagatcagttagtttctggtgtcctttacaatgaatgactccagccttggccggcaggagagcagccttaaggagggccttcattagagaggcattgataatggaagagccttgtgtggtgagaaaacctctttcagcccaaatggcagcatggttatggtagatgtggaaagcatatgtggagtcactgtaaatgttaatgtgcattcctttggcaagagagaacacacgagttaaagcaatgagttcagctttttgggaagtagtggagggaggaagtgcagcagcctcaataatagaggtatgggacacgacagcataaccagatttagctggcgagatttggctgggtatacaggaactgccatcaataaaccaagtgtggtctgggtttgggattggaaaaatagaaatatgaggaaagggggaagatgctatgtgtattagggagatacagtcatgtggctcaggatttacgttgggtgctaagtgagaagctgggttgaaatcgggtccgtgggtaatatttagcacaatgcctggtatagaaaaattacccaataaatgttaaaagagggaaagtaggaatagagttattttcaagttgaactggcagaatgagacctacttaaatgcaaatgagacagaatggcaatgtatgcaaatggggccacagattgtagtggattctggagtagactgggaagtatttatggaggaggtttcctcataggctaagacttgcttctcaaagtatgtccagtgacagcactggcatctcttggaagcttgttagaaatgcagactctcagaccctcttccagacttactgaattagaatctgcatttcaacaagatgtccagaagctttgtcgtgcataaagttgaagagcccttctctaggacacatcttgcttcttaaaatgttcaggcctgccattatctcccattacacacagcagcatttacaaaagaataattctgggggcagggagcctacactcctaaaaattcccactgcaaaaaaactgtgaatgtgaaattctaacagttatatattggaaatatgatagaactggcaaaaataagtcaaatcacctaaataaagcatgcaacataagctttgattcaattactatttatgcctaggcagagtaaaaattacaaatttttttcatccaggatgaaatgaaaaccaaggaaatatatgatcactttctttgggagggattggacagaagtccctggtactctcagatttacgaaaagcatgcatgcccctggaaggcaatggcatttcagtcacatgtttccttctgtatatccatgccccccccctccgccccgcacccaccacacacacacacaccaaataacaacacaacattttggggggttgcactgtataacactacacattgcagagaaacagacacatacacgtaagctttatccacaacttcccacttttctttaagcacctgttcaaatcttgcataccagagacacagaatcttttatctggaataatttttaggaaatagtggacaagaacaaaaggggagaactgatggggaaaataataatatctgtcatttatccgatgcctagttgtgcaagatatcgtcccagaagattattactttttaattcttgcaataaccctctaagacaaggtataaattctttattatttcaactgaggaaataaaagcctatgaagtcaaatatattgccaaaggctatgtgcctaagaagtaacataactgagcctagaacccaggtctatcttctccttccatctgtcagaataaaaacatctatgaatccactagtcatcttcttgaggaatggcttctaatttgtaattcaaatgcaatatttttttctcactttccacttcacatgataagtggggaagtggcaaaggaatattttgaagtcagactgaatttaagctgtagatggtaaagcacaggataatttcctccttggtatttgagaagttcttcatcttaaccatctgttgcaggctgacagatgggttgatatatgacagaataatgggtcttcaattctagaaaggcataaggaatgcttgaaaaatagcagctcttttcatgaacctaactgtgtaaatgccgcttgctcatttgcaaaaaaaaaagaaaaattggtgggagcaagtgtgaaatgtagtcacaatccttcccccaaacagaaaatttttcgtaattgccaaaggtcaaatgcagaaaaaaaatgcctattctaaaatcatgccagaattttcaaatttagtcacttaaaaagtcataccagggaaagcccatacacaaagaaaaaataataaaaacaactttttaaaaaaccttcttccatccctatccccagccattgaattatctttattatgagtttcttgtatccttgagggaatttaagaaacatgccgatatttgaggcctaatgatttttcctttaagcgtctctaccaaatgtaaaatgtcttccctttcttcttgcagattcaatgtgtgtgtgtgtgtgtgtgtgtgtgtgtaagtatatatatatataagtataatatatatatactaataagttactaacagcagatatctggctaggctctagggacacaggtgattaagatagtcctatgcgcaaggacctcacagtgctttttgcaatgtagcaacatgatcaaggcattccttgatcatattaatggctcattctcctacgcaaaacttcagatggccctgcatgtctttacactgtcacacaagttcttttccaatcacgtattgcaaccaaaagaaatattcacacatgcgaagactccacctatacccttaaatgcctggttattgccaaataggtttgaagctctacctatgaagaaccagtaacttaacactttaggttggaaaagtttgggccataattatttaacctcaacagagtgatcctattttcaaattaacgtcagaatccagtttgaaaaaaaaaattgagttatttcagttgaattcatggtcaaatgtcattggccgtgactaaataaggccatgtcacttgatgattgcactgtcttcaccatcatcatcacgatcattaatgcaacagctaaaatattccagtctccatgcttaacatttgtatttaattttaatcctcacaacgaccctgtaagggaagtactcctgtcccatgttacagatttgaacaccaaagaccagagaactttaaaatccatcatcaggtttgcttcttcattgcattatttccagccacagataccaactattccatgtcctatctgggagattaccagtagtgtagaatagtaagttaataataggattatgttttcaaaggagtatttgacagcctgaatttatatcagcagtttcttcccattttaatattatgtaattctggtggagaaagatgtgcaattttttctggtttccgggaaggcgtttgcaaagaacataaagcaaagttcagagaggatcttacttgattcagaaggtggcacttgaaaggcctgctagcaatttatttattgattattgttttgttttattttttaatttggagatggggtatccttgaggtaatttaggtatccttgaggtaattgttggattacctcggagcagtgcctattcacaggtgcaatcatagcacactatggcctcaaactccaggcctcaggggatcctcccgtctcagctttctgagtagctgggactacagacgggtgcaactgcaaccatgcacagtcattttctcaaaatttcccagtgtggttgtttgaaaaaatttcccatagaacataatccattttcaaatataggttactggtggggtaagttcaacatacttagaaaaatttaaaaattactttgaattgtataatattttaattatccatgcttctattatctgccattgtatggagaaaaaaactttgttgtgttatctgttttttaaaaaaatcagtttgtgtctgtttgtgtgatatcacatatatacatatatgaatttcaatacatacgtcttggaatacaccttcacagatggtttgtatagatacaaaagaacaaattgtgagggggtagttttgttcggttgatgagaaaacattgtagtctagagtacatgtgagagatgaagttcaagtctggttgcttctgactccaaccttccactgtgtctcctgtaagctacacttcctccagatgtttcatctatatgctgcctgacatctggtgttttccagctatatttataatgcccagatgttttgtgtcaagtagatacggctagttgttaattaactaaatcttagcattttcatctagctgattcaatggcagtccccaaaatatttcagaagtgctaaaaaaaatgcataaacataagaaagattgatatggtgttcaataagcatccccaaatttccagattcacttttgactaactatacaaatttattcttttcccagttatgtcaaaaccaataatcaattttttggaaaggatgctattttctatatgacatagtaattcatttagaaacactcaacaaccctcgttgctttcctaagctttcctagcaaattgctagggtaccagggtccagaaaggcaggagtactcttctactaacatttaattgtgtgaactgatccaccccaaacctctttaccccttgcactcaagcttatctttctaagagggatagggttgcaggtggggaagtatagagagacaatagtctcagcagccatgtgagacacccaaattcccaagaaacaagcagtcttctcctcatgctaatacctacctctccagcaaatagcccaaggagtctttggtcctggccaacccagtatcaacatgcatttttcctaggaaaggaacaagcaggtagtaaagaagagtccaacactccctctagaggccaattcataggccttccagataagccattttgtgttgtattcattattcaccgtgagtcctgagactgctttgagaaccatccaaggacaaaacctaaaaagatcctggatgcaaccagatctgtgtcactttctgtctccctaggctgttcagtactccccagatattgtttttttaaatttccaaaacaccaaggacttttcctacaaagctattatcactatatgcaattatgcattcttttgtgattgattaacagctctctcttctaccagaatgagtactaggaccatgtctgtttctattaactaccatatttccaagacctggcacctggtagattctcaatagagatttgctaaataaatgagtaaaccccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacgagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcatctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaactgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaacgagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaaggttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcatagcaaaagaaactaccatcagagtgaacaggcaacctacaacatgggagaaaattttcgcaacctactcatctgacaaagggctaatatccagaatctacaatgaactcaaacaaatttacgagaaaaaaacaaacaaccccatcaaaaagtgggcgaaggacatgaacagacacttctctaaagaagacatttatgcagccaaaaaacacatgaaaaaatgctcatcatcactggccatcagagaaatgcaaatcaaaaccactatgagatatcatctcacaccagttagaatggcgatcattaaaaagtcaggaaacaacaggtgctggagaggatgtggagaaataggaacacttttacatgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccctaaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtggggggagggggggagggatagcattgggagatatacctaatgctagatgacgcgttagtgggtgcagcgcaccagcatggcacatgtaccctaaaacttaaagtataataaaaaaaaaaaaaagatatgcccacccaggacctgtgaacctgtgaatgtgactttatttgaaacaggggtctttgcagatgtaattcagttaaggatctcataatgagatcaagctgtatttgggtgggccctaaatccaatgacaggtgtccataagagaaaagaagagacaatgatacacacagaaggtgacgtgaagaccagcagagactggagcggtgcatctataaaccaagccatgccaaggactgccagtagaaactgggagaggagcatgggagggattctccctcagagcctccaggaagaattagccctgctaacacttcggttttcaacttctggcctccagaagggtgagagagtaaacttctgttgttttaagccacttggttcatgataattttatagcagtactaggaaaccaatataacgagattaaaacaaatatttaaattaccagaataaaattagatcatatcaaacccaattgcaaaatgaccgaggaaaagatgacaaaaaaactgaggatacaataaaatcagaaaataaaggcaggtgaatatgggaatgctgaattaaaagggcaagggagaaactaagttaagtggatggttaggaacctgtaggaaggagataataaatattgtctctattctattgtaatataactaataaatagtagttaaggaattattaggatgtttaaggaattatcaggaataagaatgctactttatgttctactgagttaaataaatacgacacaaattaaaaaataaataaataaataaatgagtaaacccacctaatgtatttggccatcaaaacctactggataatgcctatatacttttctatattgtatttttagctataatatgtcactgaatttcctgtatcaagactaattaatagagtgaactttcaggagctgggctaagcattttattgcattacttcttttgtccttgtcaaaaatactatgaaaatgtatctcattattgcccctttttacagttggaaactgaggcttcattgggttctagggctacttagaaagaattgaaattcgacctcaggactgcctgatttcaaagacggcagacttaaccactatgtgataattcctattctaaaaacctgtatataataagaccaacataaaaaattctcaatgaagatcaagcagaataatgaatgtagagggcttagcacagcacctgacccatagtaaacatagaatcaatagagctattaatattaatgctactactaatattattaatttattttgaacagctcttaatttgctaatgttactattaactttctttgaaaggtctgtgctagttgtaataaaaagattaggcaggatcaatggaaaattaaatcatgttttgaggagtgtttttaacatatgatttacgacagtattgcagaaagctattgaagactttgcatctattctgagttcaccaaacatccaggaatacctccctcttgcaccaagattataaaatcaattgcctgtaactgaaataaagagagagatgcaggggatctaaaaatcttcttttcacaagaaaagttaagaacaagaaatagaaggtatctgttctacagctaagccaccacagattaattgataaagttttctgggaacagtctagaaaagaaaaagtgcagtatgtcaatcataatgaaatttaacttcggggaaaaagcaatgaaaccctacattaattctcaagcatcagccagattcttcacgcataaaacaagatgattgactattacccagaccttgtaacagaagaacatcagcatccactacatctctctttttgcaaaatcctgattaattggcagtgtgacaatagtgtatcttgcagttcttacatgaaacaactcaggcagagtataggccactggagggaggagaacagatctcccttggctggtctcccccactctcttccatttttagaacagtacccagcccatagcagggaagataataaagtgtaaacagacgacttggaaaagagacagaaacaacaatggacaaacaaaaaaatcaatgggatttggagtcaaacagacctgagtttggtacccaacctctctatttacttaacttctctgatcttttccttcttcatttgtaaaatagaaaaactaacagctacttcgcagggttgtggtgaagatgaaatgaggtggaacaggtaaggcatcataccttacatatggtagaccttcattcaatataatgaggttcaccttccagtgaatgacacagactttggagcttagcaaacctatgttgcaaccaaagtttagcagcttagtaactctgagatgtctagcaaatcacttaatctttctgaattttgactttctcacctgtaaaatacagtcaataatagtcacctcaaagtgtcattatgagaattaaatgagtaatgcgtggaatgttcagtgtctgatacatagtaacagataaatgatagccatgtttatatcattgcttaatttttgttatgagcctaaacaatcatggccttctaaaagcaatcgtgtttttataagattaagaatatagactgtggagccaaactccctcggttgaaatcctggctgtgcacctttcaaactgggtttaagtaatttatcccaactataaaatgggattacaatagtatctaccccaaaagggttgttaggaaattaaagaagcaaatatatgtaaaacttcaataagtgttctctaagtgttggcagctctcatcatcatcaccattaccaacaccaccattaacactatcatcattatcatcatgatcatctcttgaaggggtcacaaaatcatctccttagaaactgctacctcccaattaaaaatataacagcaataatattaattgaaatttattccggctatgacaatattgaaaatataggcagcctggtcttctgtcccttaccacttctgtgggcctcttcctgcagagagctctgcctgagctcagagaaaaccatgcttggagaaaacacacagaccccaagtaagggataaatgtggagcctccagctcttggatgtcggaaagaaaaactgaggtagggtgtgaaccagaggcaattcagaggcacttttccaagtaagtgttttgcaaatgaagtggctgctaccctgagtccttggcttattagatgggtgataaccatcaaaaagacaaacagggtgggaagttctcatccaaaatggaaaagtcctaactcacatgccaagctccttggagctggccatttgcacatgattagagactttctgacttcaatttctcctctctagtaaagataagcaaacttgatggcttgaccactcttaccccagaattccttttgcttatttaaaacaccagccctgagcaggcctggctttcagtggggtctagagctcacccagcaggtttaagccattttgccaatggatttgtcattaaagattacaaagtctaggggattagtgggatttgtctaagcacactcaatgtcaggaagaagagggactggtctcctgggaccaaaaactccaaatctggtctaagctcatttcatttacctccagaaactgggtttgtgttcttactcataaaatacaaacagtagtaatatctgcttcatagagttgttgtaaagtaaaagaaatggtgcatatagagcattttgcacggtacctagtgtgtgataagtgcctgatggtggtgggacttctgaatcttattttatatatatatatatatatatatatatatatatatatatatatatatatataattttatatatatatagttatatatatatagttatatatatatatagttttatatatatatagttatatatatagttttatatatatatagttatatatatataattttatatatatatagttttatatatatagttatatatatatagttttatatatatatagttttatatatatagttttatatatatagttttatatatagttttatatatatatagttttatatatatatataattatactttaagttatagggtacatgtgcacaatgtgcaggttagttacgtatgtatacatgtgccatgctggtgtgttgcacccattaactcgtcatttagcattaggtatatctccctcctttggaggaaagagggagctctcttcctgctctcagacactgccgctgcctcctcctcctattttttctcttccttctcccttcttcgtgctcccctctcctcactctcctcatcctcaattccttccccccttcttctcttccctttctttacttccttccccctcctcccccttctccttccccaatgctcccccttccccctccactttctcttccctatcctcctcctgtctccccctctccctttttctcttccctgttctgctcctcccctctctcatcctccttatttcatcatctaccagccaccagcctgccatgtcttgttaacagagtggtcaagccagcctttcccccaacacctaacaaaatgcagctcatgcttggcaggattgcccctgtgggccgcccacctccttctttgggctgccaacacagagggcccaagcctccctttggtcacactgatttgctttcagaccagaccactgaggcaatgaattgggtgatcatataaacccaactatgggactctacaggccaagaggaatgtgggaggcatgctggccttgtcaaagctgagctgtgggatggcttagctttggaccatctcagaccaaactaccaaaagaaagtgtggcattaatgaacccaaacaggaaaaggggcatcactgtcacttgaccatggatataaatgtgcttccatttgttaattgtggattagaactatgctgtccaataggatagcactagtaacatgtggttattgagcactgaaatgtggttattatgaattaagatgtactgtaagtgtaaaatacacatcacgtttcaaagacttagtatcaaaaaagtaaaatggcatactaataattttagattgattatatgaaataataattttgatgtattggggtttgttgtattaatatgttatatattaatataatcaattgcatcaatttctctttgctttaactgtggctactttaaagcttaaaattacatatgccgctcctatttgtggcttgcattagatttcttcaggcgtcctcattccctgctcttaccaccagggccacaattattattctttaaattaagtcatttttaaaatttaaataaatgtgtttttgaataagaccctggaccactattgaatatagaaatccagcattattaacatagttagaagacaaacatacaaatgaatcaatagaaaataaacagtgctgtattctagctacataggtataccattgcttacttgaaggatctgagcctggagccagttttctttgacgaaaaaacatgaaaagatgagcacttgttaactaagcattgaaaatggtgtagcacccaactgagactttactagtcagattgaaaggaaattgggaaggagaatgcctttctctctatgtagggatgtagcaatattgtttattgctcgttcccaccaggataggcaacccaaacttcagaaaacctgggcataatgaaaaaacactcactaaacagggaacccaatgtcctcaattcaaatctcagttacctgtgacaacttggacacatcactgaatctaatctccctcacacagctgttgtgaaggtcatacgatcttcgttgaaaactgtaggtgctccctggaagtcagttgtcattattattaacacttcaaatgaaataaggaaacaatcccataagtggatagaacagaaacttgtcctgtctatccattttttagctcccttccaagacaagtccaaagctctgcccccagctgagctgccatcttgctatttgctttctgtgtttcctgatccatagtgtcattctaaaattcttggaggctgaattagcaaagtgatccatttacagtgtggatgagagtgactctctgaactgtccaatttctagtgtagtctctctgtataaaagtgtcagcaacagaaataaataacaaagccatcaagtagccaaaacagacaataaagtcattggattaaaatattggttatatgtactaataggtagaaattgaatatttgtttattttttatcaatatccagtggagttgcttgtgccactattagaaagagatggagacaggtttacctggtctgaaatgctaaattttctgtcaccaaagatgactcccttttctataccccagggtgatcccagacaccaagattcatactattaattacatttagaaaaaaatatatttgctaacagcaacttatgaaaagtgagggcaacaaactgaatggaaacaaaccacccagccaacattaaaccaggctgcttccttgattgaggaagctgtttcttggttcactgaacagatacttaaaacatattgcagaaacacatccaggtttcctgtcaaagttctttgggtaccgattgagatgaatagctcagagtatatttatgaaccatgttatgaactatgggcaaataaatctcttaatactcctggccgcagtttcttcatctgtagtataaggccagtgatgcctcctctgactatttttggggttttatggggaccacatagaacaaaagtatgagcaccttttggaagcactgaagcacattttgaagggcagcctcttcactctatgggaataaataacacatgaaaagtgagcagaaaaggtcttcaaaggcctaatgtatgtatgataacctagcagtaaatgttaaaaatgtgtcttccatatccacactatctcttttagactgacagggatcatatttgtaaacaattggattcttgtttgaaccatcagaagaaatccacttctcaagtgtgagccatttacttctcctgatactactcaggcagaccattacatagcattaaataacacaaatgagaaagttatcccatattcaatttaactgcaagccttctgcttagatcatgctagtacagtcatgtaccccattatggatgttttggtcagcaatggatcaccaacaatatatgatggtggtcccattagattataatgaagctgaaaaagtcttatcccctggtgacatcatagccatcataatgttatggtagcataatcactctattttaaaaattaatttagtgtagtctaatcatacagaatttataaagtctacagtagtgcacaataatgtctgtcctaggccttcacattcaacttccagtgctgcaagctccgttcatggtaactgccctatctaagtgtactattttttatcctttatactatatttttactgtaccttttttatgtgtagatgtgtttacatacacaaatacttatcatcatcatgttacaattgcctgcagtaatcagaacattcacatgctgtagaggtttgtagcctgggagcataagccataccacatagcctaagcatatggtaggctagaccatctagatttgggtaagtgcactctatgatgttcacacaatgatgaaatcacctttttttcagaacgtatccctgtcggttaagtgacagatgacggtatttcattaatactcctctaacacatgttaatctcccagtataaaaattctaggctccaaagccttggacaaccatctccagctagaatttaagatattttatttttactgtatagtatttatgcttgcaattttcttctatcagtgagaagctatattggtttaacatttatagtacacatataatttctaagtagtacatataatttctaagatagctatgtaaaaagcataatttgctttaaatgaaatattaagcaataacacaggagatatgtggacaaaatcaaaattgtttaggtagtaccaaactgactaaaatttagagaacatcacttaaagttattattcacataaaatataccaaaaatcatctttctcccaaatttttggaaagcttgtgatacgctgtggtagacaagccagccatcaattataaggaaagtatttaagctgtctatgctttagtttcctcataagtaaaatggggataatgtagtacctacgtcataagatgaatgatgttggtaagcacttagcagagtgctggcgtataggaagcactcagtaaatacggacagcagctactgctgctgctcctaaaacagccaccagttctggagagcttctgatctcctctctgcccttctacatcatgctctgtgccaggaggggacaggcatgggtcaaatcaatgggctccctgccctctggataccagctgggtttggccagtggggagcctcagcaggaggtgggacaatgtagggaagtggtgtcaggttatttgttcccacatctcactttctgcaaggtatcctcaaactcaggtttatgcttaatatggtttggctgtgtccccacccaaaatctcatcttgaattttaatcccctaactgccataatccccatgtgtcaaggacaggaccagatggaggtaattggatcatgggggcagtttctccatgctgttctcatgttaatgagtgagtcttatgagatctgatggttttataagcaactggcatttcccctgctttcacttctccttcctactgccttgtgaagaagatgccttgcttccccttcaccttctgccatgattgtaagtttcttgaggcctccccagcaatgcagaactctgagtccatttaacctctttcctttataaatcacccagtctctggcagttcttcatagcaacataagaaaggactaatacaatgcccaaagccaaaaaatacagaagttcaggcttatatattcttcagaatttttgacctagtctccccatcaccatactttgcttagttaaagaaaacctgccatggctgggtgcagtggctcacgcctataatcccagcactttgggaggccgaggtgggcagatcacctgaggtcgggagtttgagaccagcctgacccacatggagaaaccccatctctactaaaaatacaaaattagccgggcttggtggcacatggctataatctcagctacttgggaaggctgagggaggagaatcgcttgaacctgggaggtggaggttgtggtgagccgagatcgtgccattgcactccagcctgggcaacaagagcaaaacgccatctcaaaaaaaaaaaaagaaaagaaaacctgttgtgaggttgctgtctgaaaccctttgatgtaaaaattctcaattctttttttaaacttttattttatgttcagaggtacatgtgcagattcatcgtataggtaaattgcatgtcacgggggcttggtgtaccaattatttcgtcatctaggtaacagaacccaaaaggtagttttttgatcctcaccttcctcccaccctccactctcaagtagaccctggtttctgttgttcccttccttgtgtccacgtgtactttaatttttagctcccacttttaagtgagaacatgcagtacttggttttctgttcctgtgttagtttgcttaggattatggtctccagctccatctatgttgctacaaaggacatgatctcattctttttttatggctgtatagtattctgtcctgtatatgtaccacattttctttagctagtgtaggttgattccatgtctttgctattgtgaatagtgtggcagtaaacatacacatacatgtgtccttatggtagagtgatttatactcctttgggtatatacccaataatgagattgctgggttgaatggtagttctgtttttagctctttgaggaatcaccacactgctttccacaatggttgaactagtttacgctcctaccaacagtgtattagcattcctttttctctgcaaccttgccagcatctgtttttttgttttgttttgtttttactttttaataatagccattctgaccagtgtgagatggtatctctttgtggttttgatttgcatttctctaatgattagtgatgttgggcactttttcatatgcttcttggccatatgtatgtcttcttttgaaagcgtctgttcatgtcctttgcccactttttaacggggttctttgttttttgattgttgatttgtttaagttccttatagatgctggatattagacttttgacagatgcacagtctgcaaatattttctcccattttgtaagttttctgtttactctgttgatagtttcttctgctgtccaaaaaaagctctttagtttaactagttcccatttgtcagtttttgtttttatcacaattgcttttggtgttttcatcatgaaatctctgccagctcttatgtccaggatgcatttcctaggttatcttctagggtttttatagttttgggtttaaatttaagtctttaatccatcttgagttgtttttgtatatggtgtaagaaaagggtccagttttaatcttctgcatagggctagccagttatcctagcaccatttattgaagagggagttctttcctcattccttgcttttcacaattttgtcaaagatcagatggttgtaggtgtgtgaaattatttctaggctttctattctgttccattggtttatgtgtctgtttttataacagtaccatgttgttttggttactgtagccttatagtatagcttgaagttgggtaaagtaatacctccagctttgttctttttggttagaattgccttggtcattcaggctcattttttccatattaattttaaaatagttttgttttaatcttgtaaagaatgtcattgatagtttgataggaatagcattgaatctataaattgctttgggcagtattgctattttaacaatatggattcttcctctccatgagcatggaatgtttttccatttgtttgtgtcatctctgatttatttcagcagtgttttgtaattctcattgtagagatttttcatctccctgatttgctgtattcctaagtattttattctttttgtgattattgtgagtgagcttgtgttcttggtttgactttcagcctggatgttattggtgtatggaaatgctactgatatttgtacactgattttgtatcctaaaactttgccgaagttgtctgtcagataaaggagcttctgggcagagactatgagattttccaggtacagaatcatatcatctgcaaaggggatagtttgacttcctctcttcctatttggatgcctttcatttctttctcttgcctgattgctccggctaggacttcccacacaatgttgaataggagtggttagagagggcattcctgtcttgttctggttttcaaggggaatacttctagcttttgtatattcagtatgatgttggctgtgggtttgtcatagatagctcttattactttgaagtatgtttcttcaatgcctagtttgttgagggttcttaacatgaagggaagttgaattttattggaagcattttctgcatctaatgagatgatcatgtggtttttatttttagttctgttaatttggtaaatcacatttattgatttgtgtatgtagcaccaaccttgcatcccagggataaagcctgcttgatcatggtgaattagctttttgatgtgctgctggattcagtttgctagtattttgttgaggatttttacatctatgttcatcaaggatattggcctgatgaacagtgttttcttttttaattgtgtctctgcctggttttgttatcaggatgatgttggcctcataggatgagctgggaaatagtccttcctcctcaattttttgaaatagttttggtaggaatggtcccaattctttatacatctggtagagtttggctgtgattccatctggtcctgggcttttactgattggcaggccttttattactgagtcaatttcagaagtcattattagtctgttcagggattcatcttcctcctggttcaatcttgggaaatttccaggaatttgtccatgtcttctaggttttctagtttgtgcgtatagaggttttcatagtagtttctgagtagtttctccactccatctttgtggagtcagtggtaatatcccctttgtcatttctgattgtgtttatttggaacttctattttgttctttacaagtctagctaccagtctatctgtcttattaattctttcaaaaaaccaactttaagattcattgatcttttgtatggtttttcacatcccatttccttcagttcagctctggtttggattatttcttatcttctgctggcttggagatggtttgctcttgtttccttagttcctctagttgtgatattaggttgttaatttgagatctttgtaactttttgatgtgggtgtttagtgctataaacttccctcttaacactgctttcgctgtgtcccagagattctggtatgttgtgtctttgttctaatctttgaataatttattgatgtctgcctagattccattatttacctagaagttatccaggagcaggctgtttaatttccatccaattgtattattttgagtgattttcttagcactgatttctatttttattgctctgtggtacatgaacattgttgatatgattttcaaaaatttactgaggatggtaaaaatttcaattttaattacattattatttgatctaattaaaatcttgttgctgttgtaagggcaaattttgccatgtgaagttttgtttgggaaaaccattggccagtgccttgattatttgctctaattataaaatgagtttttacatacataagcttatgtaaaagaaatctctaattctaccattgccacttgatatattcttatgtaatgttatatacatcaatatattttttaacaaaattgcgatcattttatatattccttcattcattctttcactcaacaaatgttgatggcacctctctgccaagaaccagaaatgagctaggtagtcaaaatgcttgcatccatggaactgacatcttatgggaagaagtaggcaaataaactgttccaaattgtgaaaagtgctgagcaaaaaagaataaggggatagagagaaaggtgtacattttaattgcagggctcaggaaagactatctggggaggggaccattaatgaggaccaattaaggtgataaagcaggtcatatggctataaaggataagaaaggaattctgggccaagggaatagcaagtgtgaagtccccaagacaggaatttgcccttctacacgatggccctaagggataggaaaggaattctggacagagggaacagcaagtgcaaaggccctggcctgtgtgcaaaggtttccacactgctatttctacttcagtctatcagaaacatttcctcttacagccattcatttcagaaatatttattgagcagctgctatgcgtcaggcaccattctttgtgatgggcaggcagtaatgaacatcataggcaaaaatctgcccacaagatacaagcaagtaaatatataatgtaccagttggtgaacatgaaactgagaaaaatgaaactggaaaaggaacatagggaatttaacataggatgctatttatatgtggtgggaaagaaagcatcatgatacaatgaaatttgagcattgatttgaagaaagaaagaagaaggagccatgtgggtcccaagagatgggagtgcccaggttaaagctttaagctacacatgctcttggtgagtctgagcagcagacagagggcctatgccgctggagtgatcacaggtccctgctatggggcatgtatgttcccgctccatagccttatatgatttgtattattgttgttgctgtcattattgcttttattcgtgatataaaagtttacatttatttgtcactcactatttaccaggcattgtgctaaacatttgatttatactaacttattttatcctcactatcatcctacaagagggttactgttattatttcaacttacagagaggtaaactgaggcctcaagtagtctagcaaatggacacacgggtaacaggtagtaagtgtcaaagtaaggactaaaacccaggtctgcctaatgacaaagtctgaacttttaactcagataagagaaacttagttatattactgatgcctctttacaaaatggcactaagggataaaaggttgaaccagcttcttaaaataccatgtttattctgaagatatagatccttgacttcaatcagaagcttgtttatggaaaaggacttcttactattttttatatttaaattaagcaggacctcaaatcctttcttttttttttttttttttttttagcaatgagatctcatcctgttgcccaggctgaactggctggagtgcagtgatgcaatcatagctcactgcaacttcaaactcctgggatcaggcgatctcccacctcaggctcacaggttgataggactacagtcatgccccaccatgtccagctaaatttttaattttctgtagtgatgaagtctcactgtgttgcctaggctggtcttgaactcctgggttcaaacaatcatcctgccttggcctcccaaaatgctgggattatagtcaaaaccaacttaaaaaaactttttagtgtcttcattttaaataggaagatcagtattccataaggcagatggccaggcttagaatccttgctcctccacttattcattcatgacttcaaccaatttgtttaacctttggtgtctccatttcctcaactgtaaaatggggtcaggattggtatctatttcatggtgcagttgtcaggattaaatgagtcaaaacatataaacttggaataatacttgacacatcataagcactcaataaatgttacatatgaatattattatttgaacaaagaaatctaacagttttctccaatttccaattgaaaggtcttcacatgactattcttttttaagtgtttccccattctatgggcctttctacaagtctatttctaattatgatgaatataaataatgaaaaccatcatactataggtaatgctttaaggtaactgtgggccctaacaaatatgtactgtcaagagaacagagcccatattttgcattttttaatcctctgtaagaccttcctcaatactcagcacattactcaaaaattactatttgaataaaagcatgaatgaatgaaggtaccagattgaacatgaacagaaagtcatgatttgacacagtcagtctggcttatttatttgtaactattcctccaatttcaaattcagacccaaacacttgagtttctttattccaaatgtttgtattactgttgaaacagctgtagatattgtatttgtttgcttgtttatacctctacctcatctcagaaaggctcataaggacatttaaaaaccaaggtgtaattgaatgaaaatgaaaagtaaaaagaagaaagggaatataaaacaaaacaaagaatcaggttaaaatacccatgccatcaaaaccctatgaatgggtcacacattggcccttagttttctagagccaacatgaaaaaaggtaaactggtcagttacgtaattcacaacagccactggatggagtgacttgcagaagattcagctactcttagtagtgagaccctccagaacattctccacaaagatcacacctaacaaatgtctggcaccacagcatctatagagtgtaaaagttccctcagtgtagatcatgggatcgtgatgaaaagtaattcagccacaccatgagagcaagatacagagcaagtcagatgcactatgccctcgggcaggaaagaaacacatgccaaattttctacttgaggaggttattattaagaacaaaagggcaaactgtttctgttggcatatcaaatatactttttttctttcctggtcggcatttttattattttaggtaagcagcatgtaacatttttacaatagtcaaacatatatatagtcaatctgaatttttttaatactatgttctaatagtctaaatcttagacagtctctcctgcctgccaccccacccgagtcatgagggaggatgagagacgtagccctcatcatcagaagtttggagatggtctctacaatactcatcctgttacatcctagaaatttcgtttgatatggataaaagcttctttcccctgcgaacagcagatgattttcagggtcagacagacctagatttgaattctggctctgcaactttctatgtgttaccttttatctgtgagtttcagttttctcctctttaaaatgggcataagaatactgtctaatatgattattgtaagaataattttatacaaaacctctcacccatagcaggcactcaaaaacattacagctcttattgtcttccacataacatagttccacattggttaacatattggttaaccaataacatatagataacacattggtttgttaagtgaacaaacgaatgaatgaatgaatgaatgagtgaacattgccatcaaagaatcttaaaccattagcagatctgtctaaaggtttggaatcatgacagcttggtggttaagaacttggactcaatattcaggttgcctgggtttgaatcctgatgccatcatgaattatctgtgaaatctcagacaagctattcaaccattctctatgttagtttgacatctgcaaataggatgatgtaccattccttacagggatgttgtaggaacaattaggtgtgggttataaagtccttagcatcattcctgggatatagtaagcatttaataaatattactattattatttattttatagaaagataaatataatatcataaggctttcttttatttgtttttctaaatgttttccttgtttccagtgctatgggatcttaaaattttccaaaaggcaaaccaaatagttatataaacaaatcaacttgtttctagaactcacattttcttttaccattttctattctgatttgtttctgtaggacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtaagtatttttcatctatgctttactgttcatatctttgtttgccagtcaaaataataagaaaaacatctcagaagtcatcttgaaaattgttgcctacaaaactaggccaatcaaaaggtgagatacttcacctcaggtacaggatgatcacttggccctcaggtttcttattgtcagaatccatcatttgtaatgttgccgattaaggagtttttcttaagaaccccgcaggtattggcagctgctgcttaggtgacagtccagttgaaactctaagccagaagcaaatataaaatctgaactttggccggacgcaatggctcacgcctataatcccagcaatttaggaggccaaggtgggaggatcacctgagatcaggagttcaagaccagactggccaacatggtgaaaccctgtctctactaaaaatacaaaaaaaactagccaggcacggtggctcatgcctatagtcccagctactcggaaggctgaggcatgagaatcgcttgaacccaggaggcggaggttgcagtgagccaagatcaggccactgcaccccagcctgagcaacagagtgagactcggtctcaaaaacaaaaacaaaaaaacctgaactttaaggttgaagtcagacaaaagttaaaaggaatatttgagggcatacaagttcctggggagaaaacactgttcaagccacatgtagctggaatacacccaactgattagagaaaaatacacagacctagtagggtgaaaaaataaattcagaatgtaaaaaagtacttataatagctatggtaatttttgaattttctccatgcttccggtttagttactttataacttcggaaaagctgcactgtattagttgaacaaagtcaaatgttatcatcaagagttatggctcttacaagaaaagagaaaatctgacagttagcagggacactaaattggatttttaatttataagtgtaagaatttgttattattccaaagaaagaagctgtatctgagaaatacataagctataatggcagcaaaaagcagcggttatcgaagaatagaaggctcagcagtgtttgctgaaagaacattctttagcacatcctagaaataattatctttgcttcaagattaacctgtgtttctacagctttctgaaattcaatctgcgaaggcacttaagaagagagaaagggttgctactctgactggactgtgatttctgctttggtgagatagtaaccatgaaaataagctctgcattagggtctcacaataatttttattcattgctgaccacacttgtaaatgaacactttgaggtatacgttaccatatttacttatacttctgtagtttgtttatagacagtatttaatgaaagctattaaaaccctgatctcaaaatctaacaggacaaaaataaaattgcttgatatgtttgttagtttaataactaatctcccaataaattatgacgttctgcatggttcttctaattccacttctgatatatctaataatttttagactaaaagatggaaattatgaatgaaaaacaatgtgatgtgtctcctaaaaccaaaataaagaatgaattgaaaccaaataatgtgatgtgtgtgaaaggacaggtccagtggtgctgtagtgatgtatccatatcagttaacagtcttctagttcctagtgacagaaaactcaattcaaactggctaaggcaaaccaatcctcatatccctaaaatctgtttttgcagtccacttctggtaccaatgtttgtatgcattagaataatcaaagctgattttaactacaacaggaaaaaagtatttggaaggatattaagtcgctcatacaacttgatgaaacctgaagaaacaggttctagaaagagcagaatctagagcagaatgagagttctagatgttcagtaccaaataattgtttcttagagttgccattagtggaaagttttacctaaccttgcattgctctgctcaaaatgcaaagttccaggagagagctcaagccatttgaccgaaacttggctctgcaaagaaaatcagatttctattaccaaaagcaggggaaaggacattaatgaaccaaaacacaatatttttattacaaattgtttggcttcaaatcatactgagctagcttatgcaaaaactgaaaatagttggaaagacattaaaagtgtgtcttcccagggcaaaacccaacagccaagaactggaaggctgccaggaagctggacagttctcatcctccatctctcatctctctttctttctgtgtccctgtccctttctgcatgtttgttacattattctctcttttcaggtgaaactttatttcttttttttcatccacacagcagaagatagccactctgcagtttctaagtttatatgtattttttaaagactgaacggcttggactgaatgaaaatcactcaggtccagttgcaaatttctggtagagagaatctcttttgcccaccttaggccagatgcccacctcagtctcatcagttatgaatagagggtttggaggatgatgtagtagaaacgtgactcagagaacacactttactgggcaaacataggttttggagtaggaggcatacccataccacaataaatgacctctacaagtaaatgagtcaggaaataatagtcatattctctaccttggtaacaaatttactatcttcaaagcactttttggcacctataattttacagtaacactaaaatgtaggtaagatatccagatactacaaatactgggagctaaggtaaactctctaatccttagttttatcatctgtaaagtggggataattgtacaacagacctcaatactgttgaaacaattcagtgagataatctataaaaaaaatacttagcatcatgcccagcttatggcaaatggtcaatacatgtcaactgaaaatggctactaaaatacggtcattcccaaatgtcatacagtgttagagcctaaatacagaaggaagaaataatgtttttagtctctcaatttctttcaaagtttcactgagcacaaatagtttggccataatttcaacttctgcttctccagcttcactccagacaaatcttagtacatctttttagacgatctagatcttgtctccccattgtttgcatgttatgtacagtctctttcaatctctctttctgttgtccccaagtctgagcttgaatcacattcttaccccaatttcagttccaacaaaatagcaaaaaagagttcaagggcccaagtgaccctaaaatgtgccagccaagagatctgtgatgctagagtaaaaaatcagtactccttaaatatgcccattgaaatgccttgtttacgttcttacttttaagtagcatttccttgatgtctaagtttttcttttttaaaatccaaatagtaacagggaaaagagaaagatcaatagataggaaatagctaaaattacatccctggacagagccatgactgaaaagatcccttgataatttttcctcccctcccccaccctcccctccactcccctcctctcctctcctctcttctcttctcctctcttctcctctccttttctgttttcctttccttttgtttccttttttctttttttttttgagacagggttttgctctgtcacccaggtgggaggtgcagtggtgcaatcatagctcactataacctggaactcttgggctcaagggatactgctgcctcagccttccaagtaccccttctgagtacctgggactacaggcatgtgctgccatgctcagctaatttttttttttttaagagacaaggtcttgctatgttgcccaggcacctcaataattttttatactcttatattgacatacacttgtaaaggtgcaatttaatcaagatcccccttttaacggaaaatattctggttaccatgcacatggtaaaatggtcctgtatgcaaattagagttttgtcagtagttaactaatttattttgttcaagcaactattataccttatttacgttttgtatctccctcagcaggtagcctagagcatggcacaaaataggttctcaattagtgtaaaaagtaaggaaagaggatgcaagaggagagaaggaagaaggagggaggtctgtacaaaccagtctttaattagatcagttgggggcctagagtcttgattttggctattgtctcaagaacatcgtctcactgtttgtgcctcagttcaatttatgctgcagcaaaaaaaaaaaaaaaaaaaaaaaaaaaaagtctgcaaagtacaattcacagaaatgttttagaaaatgattcagagcatagtttaccatttagtaagtatttgctaatgtgtccagcactgtccagctactttacacacatcctctttaatcctcccaactaccttccaagaaaggaattcttgtctccattccatacaagaaacaaaacaaaaacaaaaatgaagtctacagactaaatgccttgtcccaggtagcagggcaagaaagtacagtccccagggtgcctttgatttcaaagcctatagagatttctccaagcctaagattccattcatgtgctgctaaaatattgaaatattttgatagtctcagatccaagtctccaaggcccagcttcttgactacaccagtgccccctctgccaccactacccacaggccactgtggatcatctcactgtccagaaactaagggatagatattgacccagcaaaggacttccagcaccctactccaggaccgtggccactgcccaagtccattttgattggtcagcgtcacgctagggggtgatgactaaatatactttaatgttatcacagctttgcgttatactactgttacctgtctccattagggggctgttaaaacagactgcctgtagttaattcccaagtcaatcaaccagccttggaaaaggctgcagaacaagtcatggaatgaggacttctgttcgggcctcatgcaatagcaaaccgttctgcttccatcaaacctgaggccctggggaggcgacacccagtcctctggctcactgacaccctcctggagagtaagaggaatttccataggaaagtttcacatccagttcttaagaaaatattttatacttctctgaaacctgcactttattcacagtctggtttcaacattcacttatccctgtgagaggcacagaaagtgcaattattcgaacagtcaacctctcaatatgctatcatgcatatgcttatttgcatatcacctgtaccattgcttaccctatatttttaattgactcactttctttatatgattacaacaaatggaaaagcaaaagcagtatctctaaccataaagagaagatagccttataaatgaatgcaccattattaaagtgaaaattctcaaccctgtgccatctggaaataatcttacacaccatgaaggatactttatttggagaataagtgatgccttaagtaaggtttccagttatggaaccagaagagagtttggatcacagatctactactcagcaagccacgcgaccttagacaagctttccacatctttaatgtgggtatgacaatagcaactttttcctagactgattcttagagcaagtgaattgatacacataaagccctttatgtagtgcctgacatgtagtgcgtctaataaaggtcaaatattctaaatgaaataccggttccaaatggaaaacttggaagcggactcaacattaaagtgaaaagtgatcttttgtattgtgaaggatttttccaaaattgaaatttttcttgggtttttgtctagtctatcaattcattggctttgattctccttcaggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatgtcttatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaaatatttgcattcttgtaaccttctatggtgttttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtagcccctaaattaaaaatggcttccatatgccactctgtaccccaaagagagttctcatgaaatattctccagaatgtattcattatcaagaaaatgtcaatcgtcacttcctcgttttaactcagctgaaacaccaggacccaatagagagggcaagctgagcatctgtatttccagataaaagttgttattgatgtataaactcgttgcgtgattagtgatgttggaagcattttagcacaaaacagccttgtgtcttagatgatatctgtaaccagtttctgaatcccgttggataaaactgtattgtgatatctatttgatgttaataaagttattgcataca

SEQ ID NO: 223 - DNA, 35619 bp, Homo sapiens
cactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggtgaggcccggcgaggaccggaaaggaccgggaaggggaacttaggccgcgcctcggcgccccgcttccgccgcagcctccggctgcccgcagccgctgggacctgcggaacggcatggtagggaggccaggggcggctcccgcgagcgtggaggacggggacccttccgcggtgcccccgccccgcgccccgggccgggccgggcctgcgagggaccggccaccgcagcccagcgtgcctccgcctccccgggacgtccccgccaggctgcgagggttgcggccggccggcgcggcctcccaagggcgatcgcggagacctgggaggcgctggctccccagcctttagccatggtgagcgtgtgcatttcttggcctcagagggaatggttactttggtgacttctgcgaagttaccgtttaattgtgcccaaccgtttcttccccatcttgagggggaattggtagtgggagttgatgggtgggtgacagagtttttgttttccactaggcttttagtttttgcatcagcgcaataattactttttctttcctgattagctttctggtttgagtgagcgttggaattgtagcagaggagcagtaagtttgcattacagaaactaggaaaactctttttagttatttactttagtagctagcaacttttctgcaatagaacatatttggatttttggccagtatgatgtgatatttaattatcttgacacggtagaatttaaaactccttgcgattttgatacctaatgatttttttcccctgaaagtttctctcactctttcgtgtagtttaattgctcatttttgaagtcggttgatgaaatgactggcaattctaatgtcttgaggcttgaggtttgctaaattttttttcatttcgtttttataaaataagtttagatagattgtgtagcatattaacttctctttctaatgtaggctattgaagaggaaggaggcgatccagataatattgaattaactgtttcaactgatactccaaacaagaaaccaactaaaggcaaaggttgttacgagttatgaacatgttttaaaatatattttggttatataacttgcctctgctcttgtgcctcttgccctgtttatatagtgctactctttgctatttccctctggcagtctgccttcttgggtcaaggaagaaaagttactgttgccaggctttgggtgacttgtagcccttaagattcggctgaagctgattagaaagtgagaacagttctttattgcttccggaaaaaattacaaagtcaagttgtgtaatgatgcttcatagtgtgaagacctgaataaaatacagtttaacacatgtctaccttgccccacaattggcagagttttgatggaattcctaccaaatcttttaccttgcctccttgctgttttctttagtatattaaaattctataacctttatgtttagtactttgtttgacttggtgaacttaatttgcatttatgccattatacctcctaatttttagtgaaattcaaaaagacctcaccaatcatactaacaaggtagagggaaaaatccatgattaattagcttaaaaaagttttaaattatagggatgttaaagattcttatttttaacttttaagctagagcaaaatatatttatttctaggatataatgatttagtgactagctaaaagtggttttaaatgaacgttttgcagtatgaatggaacttaggtattttttaaagcttcttggtaaatgaaacctttatttgaataactgcaaatttctccctcctataaggacagtggcagagggtggacatgatatatctggattctggtctttacctacaattttcatgcagagtttgtcatgaacagctgctgcattttttgtaatctaattttctttactgctttaagtgatccaagtgttactcccaaccactgaatgattgcaactaaaataaaatgaatggattaatattgaaaagggaatattaaattttgatcttaagcacacctgggtatcagagatgaggacaactcactattttaagtcttcctaggttaggagagtcccctgtttgtgccaaaggaaattgaaaagggctaataagcattccctgggagaggtggggatgtagtttagagaagtaaaaaagttatcttaaaggtagcttttaagataactctgactcagtgtatcactttgagagatacattttctgtatttaaagaagcttgtcatgagaagactgccaacaaaccagaggctatttcaaaatggaaaacgatagaaattcagaaataagtatatcaggaattaaccatgtgtcttgcagtagttttgattcatatcttttacctagcatgctgtgctagtttgacaggtactgtgtattaatcatagtcccaggttgtttgagttgactattattttagcattgaaaataaacatgatttattcctttctcacctacttttaatttctctgtatatccctttttcagttttgactaggaacatcatttatctcttattattagaaataatttcagcaatataaaattttaagggttttttcaatacattttatgacaggtatatatatctatatatatgatatatagattatatataggtgtatatatatcatatatgatatatatatatattttttaatagggtattgctctgttgcccaggctagagtgcagtggtgcctagctctttgcagcctcaaactcctgggcttaagtgatccctcccaccttagcctccctggtagctgggactacaggcatgtgccaccacaacattttaaataagtaaacattatttatttttatcagtatgtttgctaatttttttctttgtatgggttatacttgaactttattccataactctgatgttaagaggtcttaaggtattcagttagaagttgtaacatttgggggccgggtgcagtggctcacgcctgtaatcccagcagtttgagaggctgaggcgggtggatcacctgcggtcgggaattcgagagcagcctggccaacatggccaaaccccatctctactaaaaatacaaaaaaaaaaaaaaaaaaaatagctgggcatggtggcgcgcgtgcctgtagtcccagctactcgggaggctggggaggctgagacaggagaatcgcttgaacccaggaggtggaggttgcagtgagctaaggtcactccactgcagtccagcatgagaccccatctcaaaaaaaaaagaagttgtaacattcaatcatttgtttgtagcaggcctcattctaagagatgcatgacaaaaagctctagtcttcttgaaatccggctatcattgttatgaaaatcttgtgaattacaaagaatataatgtaaatctccaactccaaacagtttgaattaatttacaataaagatgcttattgattcaattattttatttttattatttttaatatgagagattttgaacccagtttacttattaaagaatgctcttgtctcaaattccaagcgctactgatcatctttagagccagttttgcttaaatgcgtcataccaactcagttctagccttctaaaatggcagagttctaaaatggcagagatgttttctctgccattttacaaagtgataagattattttaggccgggtgcagtggctcatgcctataatcccaaaaggccaaggtgggaggatcgcttgagtccagtagttcaagaccagcctgagcaacatagtgagaccctatctctattttaaaaaagaattaagatgtttaaataataacttttagaaaccaaatttgtatagggaaacttattaaaatatcaataatgaacagatttgaaaaccaaggatatattaaatattgttttaatgtgatgtccgtttttcttttcttttcttttttttgagatggagtttcgctcttgtcacccaggctagagtgcaatggtgtgatctcggctcactgcaacctccgcctcccggtttcaagcgattctcctgcctcagcctcccgagtagctgagattacaggcatgcgccaccactccaaactaattttgtatttttagtagagacgggtttctccagttggtcaggcttgtcttgaactcccaacctcaggtaatcctcccgcctcggcctcccaaagtgagccaccgcacctggctgataatcagtttttcaatcaagttgctgaattactacattcaattctttttgccagatcttgttttacttactggtatctacattgaaaataatttcatcttggttatgccacttttccttcagtgcgcctgttttctcttttgtaaaactggaaattttactaggtcccctgtaaggctcttttagttctgaaatttaataattatatagacaaaaatgagaagaaaatgctttctgtttaactaaaatgatgtttaaggaagcaacaggtaagctcataggaaatcagtatcgtttttcttcagcacaaattattagaaaacgaaaagtgccaagaaggggattacgtagaggtaattatgtagacatcagcgagacataatatataatagctggtcaggaaaagaaatgattcttatgacaatattaaggtagtgaataaaagttaaatgacgagaagcttcataggtatggaaaaaatactttggtgaaacattgagcttattcttttataaaataactatagggtaactttcttttaaaaatgtatgttaaaatgattctatttagagaggttagagggaaaggaacctacatttttaagtttctcctagaatattttttaaatgcagctattacaagcacaaacaatgttgataatgttatagtgggctctgacatttatatcaacatatttataaaattcctttacatgtagttaatagagtagatgtttgtatcttagaatggctttcctgagtcttcacactctctttgttatgaacttttaaataagtaacttaggagaaagcttcacccattgaagtttacggttatattaattgggtgtgtgtttaaaaagtagttaaacaggtagagctaacttctcattaggttgttttagagattatagatttaaagacttttggtttacctgatgctggcatatccttttcttttaaaatttcaacctttaaagtcaccaattaacttcagcaaaagtgatgtggttaatcagtacagtatttagaactatatgtaatgcaatacttaccgacattaaaactaatttgcaatacctggcagctttaaaaagactaaaaatgatgtgtacaatctgatttttcttctatagaaacaaatatattttgaggttataggtttggccaaacatctaatgtataattttttgtggaaaataccacagactacatatttataattaagtacatgtttactctgtaaagctttctaaaactggtatcaattaaatgtagtaatcagccatataaagcacatttcatataacacagtatcatagtgtactgtaattagcttttttcctccagctgtagtatgttcagatgttaagtaacactttaatcagaactgtggcattgaggaggactttgggcgtataattgttatagatatttcttaggtacctgaaaggctgaaagctctgaaggccaggacatagtttttcatttacctctgtctctgtaatgcctggtgtagagcatggcacgtaataagtgctcaaaaaatatttgttgaatgaatactgagggcctttttggggctttcttaactgcttttagaaatacctcttttgggccaggcgcatggctcacgcctgtaatcccagtactttgggaagctgaggtgggcggatcacctgatgtcaggagtttgagaccagactggctaacatggtgaaaccccgtttttactaaaaatacaaaaaattagctgggcatggtgtttcgcatctgtaatcctcgctacttgggaggccgaggcaggagaatctcttgaacctgggaggcagaggttgcagtgagctgagattgcgccattgcactccagcttgggcaacaagatcatcatctttagataatctgttcatctttagaaacttggtctcaaaaaacagaaaacaaacaaaaaaaagaaatatctcttttggtgcctattttaattgcatatttctttgtaagaagcaggtatatcagggattaatagtttttatcttttttttaaaggtgcctctctcaagagcataatggcttctccttacacattgatatgtaaaatatacttacttttagaacacatgaatcattgcatcatccttttattctttaccacattgatgctgtgttgaaaagcctctgaaccttgctggaatactgtccaacctcagaggttgtatatgtcattttcatttcacaaaattagcccttttatcgcagccattaaaacatacatttggccaggcgcggtggctcacacctataatctcagcactttgggaggccgaggtgggtggatcacaaggtcaggagttcgagactagcctggccaacatggtgaaaccccctctctactaaaaatacaaaaattagccaggtgtggtagcatgttctgtaatcccagctactctggaggctcaggcaggagaatcacttgaacttgggaggaggaggttgcagtgagccgaaatggtgctgctgcactccagcctgggtgacagaacaagaccctgactcaaagaaaaaaaaaaaaaaaggtaatccagaaaagtacaaaaaagtgaagattacccgtaatcccaccaccctgaatttatcatatgtagcattttacatatgatatatatacatgtttataattaagtacatgtttactctgtaaagctttctaaaagttaatctaatatagtaatcaaccacataaagcacatttcatattacaacacatgttgatctaagttgtgtaggtgtatgtgcaagtacttacaggaggtttatgtttaaaggttttttccccccttttcaacaactaaaatagattcacaccatacatggtgttttgttgaaggtagatagaacttaaatatttctgtagtctggagaatcaaaaaacaataaccttccgtctatattcttctcaacagcttctgtaaatagattcacttgtcttagtggctcatgatctgcactctgcgttagtcatttgaattttaaaaaatacagatagcaggctttcactccccatagagttggtttgggttgttatgttgggggcccaggcatcagtatgtattttctaaaagctccccaggtgattcttacatacacctgaagttaagaactaactaatctaaactaaagcttgaaatttagcatcatttttattcatctctctgctggtcagtttctagattattttatatacttttcagttttcggaaaacttctacattgctttatttgattctcacaacggtgctgagagttaagcaggactattttctttttactggtagaatagaaaggtaattcattaagaacccagttaaattacctttgacagtcttgtgtttgtaggcacacctgcctgaaggagtgtgccggaattgtttattctgttcatctttagataattaatgtaagatatttgaaaaatatacctttggcatattctaggtttattataatgaatgtgaattatctttgtagtaatttttcaaagtgacctattgggccaggtgggatggctcactcttgtaaacccagcactttgggaggtggaggcgggtggatcacttgaggtcaggagttcgagaccagcatggccaacatggtgaaaccccatctctactaaaaatacaaaaactagctgggcatggtgttgggcacgtgtaaccttagctactcaggaggctgaggcaggagagtcacttgaacccaggatgcagaggttgcactgagctgagattgtgccactgcactccagcctgggcaatagagtaagaccctgccacaaaaacagaaacaaaaaactcagagtgacctattgtatgactgttgtgtttaagacaatgtgcaaggcctttcagaaaaatgattttgttagtaaaatgtcagtttaatagaagagaagctaaaacacttgcaaacaatacaaggcatggcctgtgattaagatactccatgcaattgggaagaggttgttgctggaaacatttcagtttggcatatcttcttaatcttcccctcccttgcaacagaaattttataactaagctttttttttttttttttttaacattttatcgtagctcttgtgaatgtttaaggggaaaagttactcagccataaagtattttggcaaaatgattttaaaatttccttaggctgggagcagtggctcacgcctgtaatcccagcactttgggaggccaaggcaggaagattgcttggacccaggtggttgaggctgcagtgaaccatgactgcccctgcactccaccctgggcgatagagcaagaccttgtctcaaagaaaagaaactaattattaagtgggatttgtttttgtttgggaggtatttctgaacttaaaaaggaaaattgcaaaccattatagggactagtttgcctttggaggaaaaggaaaattgcaaacccttataaagaccaatttgcctttggaggagaaagccaatttatcatccaaaatcctcagaattctcaaatacaaaaagttctgaaaactgaaagtttcttcttaagtttggtggcaaaagttatttatagtcttgacttatcccatttgatgtgaatctgcttacatttcattgcacaaaatgtttctgtgattgtgaaatactgttccagaagccactgggaggtttaacttaataaatagtatatgcaacgttttactcttctaaaatctgaaaattgtgaattctgaaacatatctcagagggtttcattaagaatttttgggcttatacaaatttatgctacataaatgtttatagtcttgtctttctctggtatatacgtttttactttgccattttactttaggccctcaaatcatgcaagttatattttagattttgtttttgtcatttcaaaatagctatgttactactatgatagtttaggatgtgataggttaatcttgctttcattttttattttgttattcagattatgtttactgcccaatttattttgtagttttttcctcaaagcgtaaaagtttggcttcaggccaggcgtggtggctcacgcctctaatcccagcaccttgggaggccgaggccggtggatcacttgaggccaggagttcgagaccagcctggccaacatgatgaaaccctgtctctattaaaaatacaaaaattagctgggtgtggtggcatgaggctataatcccagctactcaggaggctgagtcaggagaattgcttgaactcggaaggcagaggttgcagtgagccaagatagcgcctctgcactgcactccagcctgggcaagaagagcgagacagtgtctccaaaaaaaaaaaaaaaaaaaaaaaaaaggtttggcttcaatctgccttacactttcagttagttcctttatcctggtcatgccactttcacagttttgcggcagttgctagattccctgtaggacaaaagaggtgaaactatttagttgatttgctgtaggagctttaatagcaaaggtttaaatcgggtagacataaatggttacttgactctacaaaaatgtgctgaagatagtgccgcttgtcggaatttaagggtgatttggtctttaaaattctttctcgtgtgtgatattacaaaagttagggacctgcagaggtagtgacaggatgtattgacaggatggggttacacacaaagttagttgaactgccatgtcacccctttctcccagttgggccaaatagaaatccagaccttgttttcttgtttttaacttttagagattattttatttatttgtttgtttttgaggagtctcactctgtcacccagattgaaattgagtggcacaatcttggctcactgcattcttgacctcctgggcttatggtatcctcccacatcggcccccctagtagctggatggcaggtgcacaccaccacgcctggccaatttgtgtgtttttttgtagatacggggctccaccatgttgtccatactagtcttgaacttctgacctcagttaatcctcctgccttggcctcccaaagggtttgagattacaggttcaagctaccatgcccgacctgttttccatgtgtccagcataggacttactccattatcagtcagaaaatatataatgcggctaggtgcagtggctcacctctgtaatcccagcactttgggaggctgaggtgggctgatcactagaggtcaggagttcgagaccagtctggccaacttggtgaaaccccatctctactaaaaatacaaaaattagctggatgtggtggcagcacgtgcctgtaatcccagctacttgggaggctgaagcgggagaatcgctcgaacccacaagatggaggtggcagtgagccaagatcacaccactgcactccagcctgggtgacagagtgagactccatctcaaaaaaaaaagaaaaaagaaagatacaatgcttgaatatcggttttatattatatattttatatattttttatatacgcatataatatataatatatattttatacatgtatataatatattttatacgtatataatatatattttatacgtatataatatatattatatacatattatatacatataaaatatattatatacgtataaattttatacgtatataatatataatatgcatattgtatattatgtactatacatattatatattatataaatatatatatagtgttgtactaggttctgagctggctgataaacattatagcttttttttttttttttttttttgaggcagagttttgctcttgtcacccagactggagtgcagtggcatgatctcggctcactgcaacctccaccacccgggttcaagcaattcttctgcctcagcctcccaaatagctgggattacaaccatgagtcaccacacccggctacttttttgtgtttttagtagagacagggtttcaccatgttggccaggctagttgcacactcctgacctcaagtggtccacccacctcggcctcccaaagtgctgggattacaggcgtgagccacctcacctagcaacattatagctttttaaaatgagttatattttgtatggaggggaagtgttttttcacaaaataagaaattacaatatagtcggctggagtcaggagttcgagactagcctggtcaacatgctgaaaccctgtctctactaaaaatacaaaaattagctggggtggtggcatgcgcctgtaatcccagctccttgtgaggctgaggcatgagaatcgcttgaacctgggaggcggaggttgcagtgagttgagatcatgccactacacttcagcctgcatgacagagtaagagtctgtctccaaaaagaaaaaaagaaaaaaagaagttaacaatatttaccatgtgtaaagtttgtaatttacgatgtgtaaaacaagccaaaagttgccaattatgaaagcagtccaaagctaatgtgagatttcattttttttgaatactatgtatctatcaggttgttactccagtttcatcactgtttgacaatcttgtcctaatgtcttttaagattacaagctgaaacattaaatgtccagtgtgattgtattgtaacagctgttggaaacagtatgggacagcaaagttagaccatttttacataccccagtgctgcctcttgttgcctgtgcgtcatcgtcattgggcaagtgagtctcacattttaaaatttcatacatgtggattttggaacttctgtttacactaaaagagataatattttaaacaactggcacattgtaactcctcagagatcgaatggttttgaggaatggaaattgggctgcatttaaattgaagcactgccatttactagctttgtaatctaatttttcagacttagtgtctcttttgtaaaaggggcataattgtttcagaggagttgtgaggataaaattttaaaatacaagtacataaatgcatatgaagaatttatcctagcacctggaccatagatgccacttcagtggtaatgactgctgtttttgttgctgaagtgtaatttgattttcctgtttttcactaaaagaagagaaattcgacacagagtgtgcatactatgcaatttgtcattatgctgaggactgccatttcaaagataatacctttattttaaaaattttttattttttatttttttgagatggagtctcactgtgttgccaaggctagagtgcactggtgcaatctcggctcactgcaaccttcacctcccgggttcaaaggattattctgcctcagcctcccgagtagctgggattacaggcgcccatcaccacacccggctaatttttgtgtttttagtaaagaatgggttcactgtgttggccaggctggtctcgaactcctgacctcacgtgatctgcccacctctgcctcccaaagtgttgggattacaggtgtgagccaccacgcccagccaaaaaatttttatttatttatttatttatttatttatttatttattattttgagatggagtcccattccattgcccaggctggagtgctgcgttgctatcttggctcactgcagcctccacctcccgggttcaggtgattctcctgtctcagcctcccaattagctgggattacaggcatgtgccaccatgcccagctaattttatatttttagtagagatggggtttcactgtgttggccaggctggtctcaaactcctaacctcagatgatccacctaccttggcctcccaaagtgctgggattacaggcatgagctgctgtgcccagccttatttatttattttactttcaagacagagtgtcgctctgtctctcaggcatgagtgcagtggggcgatctcagcttaccgcaacctccacttccccggttcaagtgattgaacccagtgcctcagcctcctgagtagctgggattacaggcgtgcaccaccatgcccagctacttttttgtattttttagtagaggtggggttttgctagttggccaggctgctctcaaactccgggcttcaagcaatctgccctccttggcctcccaaattgctgggtttacaggcatgaggcactgcgcccggcctcaaagataattaagttgaattaattcaccactccttattagaataatgtgttttatacaggtcataataagatatagtggcaggacaagattggtcacgaaatcctggcttcagttctgacagcaccattttcaagttttaggcaaggtatttaacctctcaggctcattttctcttttgtaaaattgtgataatggacctatgtaccatcatagggtgcttggacaaatcaactgaaattttttttaagtgctttgcaaattataaggcagtttgtgattataaggaataaatagcatttataaatgatctacaggaattcccccaaaagttctgctctataggctatttggtggtgagtgtgtatgggagaggatttgatgttttggtttattttgcttctgaggtagggtctcgctctgttgcccaggctggagtgcagtggttggtataattacagctcactgcagccttgccctcctgggttcaagcagttctcccacctcctgggttcaagcagtcctcccacctcagcctcccgaatagctgggactaccggcatacaccgcgacacccagctgtgtttaaaaaatttttttttgaagagatagggatctcactgtgttgcctgggctggtctcaactcatgggctcaagcgattctccccctccagcctcccaaaatgctgggattacaggcagtagccaccgcttccagcaggatttgatattttaaaaaagcatttttctcccaaaaagtagcctctttaaggtttttgtattatggaactttctctaaatgtaatagaagaatttaattatctgggcgtggtggctcacgcctgttatcccaacactttgggaggccgaggtgggtggatcacctaaggtcaggggatcgagaccatcctggctaacacggtgaaaccccgtctctactaaaaatacaaaacattagccatgtatggtagcacgcgcctgtagtcctactacaggaggctgaggcaggagaatcgcttgaactcgggaggcagaggttgcagtgagccgagattgcgccactgccttccaccctgggcgacagagcaagactcttgtctcaggaaaaaaaaaaaaagaatttagtagttttctttttcaggaaaaggacatctttagttttttttctttcttagtgattgcccttttagtaacttctaattttagattttagggcaacataatcagatagacttgttgttatgtgaaattctcatgtacaaattaagtttagtgataaagagaatgatgacagtaattataaaattatatgcaaagcattaatctacaaagggaatagtaaaccaaaaagttaaaccaaaaagttatgttttccccaaaatgcaaacgtcaacattgtaaatagaaagttaacacaacaccaagcgccacacttcatttcttgtttggttctcacaagccttcagctactaattgagtaaaagaaaaatccccactcctaatcttgttttttacatacttggaaggactagcatatcttttccccttttatcactcatttgcggaaatgacttagaattgggagtagatgacagataggagctaccgaggagactagggaaatgcaggtttactaacctttaaaatatttattccaacggctaaacctctaccctgattactgaagcttgaactaggtagtagcactgtctgtgccagttgtaggcaaagggaaaaaagttcattcgttggtcttaggaaagaacatccattcatgtttcaaaagaaatgaaaaaaaaaattttttttaataaacttccagcagatgtcttttttttatggcatttctagtacattaaggatttttaagtaggattttgtggactagcctgaaaacataataatgttttagcattgcctctgtggaaaacttttttttttttttaatgtggaaaattattttaaagttccaactaccagctgggcgcaatggctcagtgcctgtaatcctagcactttgggaggctaaggcgggcagatcacttgaggtcaggagttcgaaaccagcctggccaacgtggtgaaactccatctgtctctactaaaaatacaaaaattagccaggcatggtgcctcgtgcctgtaattccagctacttgggaggctgaggtaggagaatctcttgaacccaggagggggaagttacagtgagccgagattgcgccactgcattccagcctgggcgacagagtgcgactctgtctcaagaataaataaataaatattcttaaaaaaaatttctaactaccaggttgcaaagttttgaagatgggcaaagaaggtctgtagtttgtcggaaagctattaacagttttcactctgcagtaatttctgcatgccttaaatcagttattatgttaagtggccagcactctttatatttaggcttttggagaaataaataattagcataaaagtagtcactgtatttaaagaatttcttctctatgaagaggcaaggtgtactagagacagagtacaaggcaatatgtaatcaaccacctgatggattgtaagatgaagattaaagtgtgaggatttttatttcagagaatgcttgttgaagagaagaacataggaaaggctttgtgggaggtacagatcttgtacttagctatcaggtgtctatatatatagttagtagaatgccattgaaaggtatcacagcttctcagataactgaggatagaaaattcaactggtgtaaagaaaaatgcaccatatatgtcaagtcagttaagctgatgggttcatatgtaggattctgtgcacggtgtatttcaatgaagcagcatgacataggaaagctttttttgtttgggacagctctgagcaggtggtttagaagcagttgacattagctttgtcagatagtttgggagtggagagtgctattgcagggtaaactctgaatattttttgttcttaaagtaataaaatattggttgttagcccattttccttctttcgcaggtaaaaaacatgaagcagatgagttgagtggagatgcttctgtggaagatgatgcttttatcaaggtaaagtgttaattactcaggttaagatgcttattttaagcctagtattttgcatcatgaattttgtgctttttgttgaacaatggtcactgaagtatgtaggttaaagataaagacctatgtaatattgacaacgtttaatattgtcaatctcattaactctcataattgagaaatatagtaaataactttttctttagttaaatgagatacaaaagctaaaattaataatctctccaggcctttaggtagaaagctggccaggggaatagctacgagacaattgatatacatgttagttcctggatgagatatcacagggaaggatattggtaatttgttttttatctgccattgcatttagcttttgtatataatatacagaacttagattaatgtagaccttaaaatacacagagaaaattgctgatgtgttactacttggtaaagatcaaattaagggccaggcgccgtggcttacgcctgtaatcccagcactttgggaggtctaggcgggcggatcacttgaggtcaggagtttgagaccagcctggccaacatagtaaaaccccatctctactaaaaatacaaaaattagccaggtgtggtggcgcatgcctgtaatcccaactacttgagaggctgaggcaggagaatcgcttgaactcgggaggtggagggtgcagtgagccgaaattgtgccagtgcattccagcctgggtaacagcaagactccgtctcaaaaaaaaaaaaaaagagagagagagagatcaaattaagaaatttattttgccctttaaagataaataagctaggccttttggggccgaaaatgagtgtatttcaaaactggctggccagaaaaattatggatgtaattttaattggggttgtggcagttctatatactacagctatagaacaagctatttttaattgtagttagggttttttaattttttttttattttaatgaaaagtgatctactgcttattaggtcttaagtattgtggtatttgcaggaattatttcatgagtatagttcctcttgaattatatacatttatgtccccatatattctgttttctgggtaaaactagtccatattgtcatcatgtctctcgatgtttgtgttttccatagagtcagctcatgttcatttacccacccatctctcctgcctcctagctctcttcactctccacgctgcacacacacacacagacacaaccccacccccaaaagatgttttgttgaggagttagccctgaaatcagttaattttaggaactgtttgcccagggatccgttaaaattgatgattgcatgcctgtaatcagcttgtgtttgagcctttaagttttggtattctgttacccttactatatatcttccatcaggtttgttcctttgttcctattttctccagttgtcttcaccagtaagtgtatgattaagcaaagattatccataagctgtaaaaacattgtgactcagtaaaaaatcttttacttttcaaatttgtttctttcagctcttcagtttataaaaatgttacagtcatttgaaatggcctaaggagatatatacgtctattgagacgaacaatagtactgtctcttatatgtgccacaaaggatgcttttgtgttatgattaaataaacctggtcataatgtctaaaagaacaagggaactttttttttgtttttgtttttgtttttgtttttgtttttgttttttgagatggagtctcgccctgttgcccaggctggagtgcagtggtgcgatgtcagctcgctgcaacctccacctcccaggttcaagagagtctcctgcctcagcctcccaagtagctgggattaccggcttaccgcaccaggcccggctaattttcgtattttagtagagacggggtttcaccatgttggccaggctggcctcgaactcctgacctcatgatccacccgtcggcctcctaagatgctaggaatacaggtgtgagccaccatgcccagccctaggagctttttaaaaattctgtgtaaagatatcttcagtttatttttggaagtatcaacatatgtgatgtatttgatagaaattaagtgaatatattttctcatctcccacagttgataattttggaatttatacagtaatggttggtaaatatcacctattgcctaaataccagaatagtatagaaattgcttctgtaaataagtgaggagattggtcaaagttggcaccttagaataggtgaagtttccttggtaacttcccttgatctttcttgcacctattcttctgccataatacagccatgtactccattttcatcccctcacgctcccctactcatgctgtagtacatttggtcaaacaagagatcccctgctccccaaggactccaccttccaaaacagtcatattctctatgcccacctctcgatagaaatttccatttcctcactgcagtttggctgtgaatgattagtagtcatgcctctgcctctttcaccttttaacccagaaaccttttcttaaatctgctggatttaccgtaagaacaggaaaaaaggaagtaatgtttattgctttcaccccttttctcttcatttaatcaggaaattaagcagattgctgattttgttttcactgaagtaccatatattcataaactttgaaggacaaacagatccaatcccaacctatgttcctcttcctaattgacatttggcacagtggtagatttcaaaacaaatacatttcaattagttatttgcatatttttcaagaacagacattgatgcagcagttgggagttctttattattagaaataaactttgttttaatgtataagacttccgaagtctttgaagttaaatcaacatatggcacatggaaaaatgaagccgtattttttggacagcttctagaagctggcttggtaaatattaaataactggaatttagagcatctctagcagcaatttgattagtgtgcattttagtgtgagaaatttgagaactcagattcgtgtttgatgatcttggtattagacctatttttaaagacacagtaaatatataaggtaaaatgaatgaactttgggaatattaaaatatgatcaaatttgacacatttaaaggtgtaaattaccaaaaacgtttggtggatagcccacactactttgcctctagttgtaccaaattttcttaccattaaaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggtctttagccagttttttttaaaacatgacacagataaattaagttttaaataataaaaagtatttttttctagttcaatttggaagtctcagaatttttaaaagatgtgttactaaagctacttataagtcatctaaaatcctaccaccttaggcaaccttttaaatttttgcttatttcatataatatatatttatacatagttgttatagagtaagttcctatttattctgtattttcacatgacgtataatttcataatttccccataatttattagactgctttctacatatctaatagacactcctttaattttggacattttaagttttaaggcttttttcctactccacgatgaatgaatgtaccaatttcattctggcattgccaacattacttggtggtagggttttttcccctttctgctaccttagcaagtataaaaggttactttaatttacatttctttggttatatcaagggtggggaattacttatgaaagtttaattttaaagcagataatatttcaaatattttctttgaaatagaccatttgtcctgccttgaagtatgttagtacattttaagaaagtcagtgggttaaggagtcagtgctgttagtattcatgcttaaaacacttcccttctacctaccctaataaatgaggggctcaagagaaatatttctaattctctagcgacatggctaattttttttggcataaaaaatatagtctgaatattaagcattgatttagtacccatggtatcgcagatattatacagaacacaaggcaaatgataatcaggtgtaagcataaaagcattctcacgttaccccgatattttataaagcaaagctattgtatacccttttacttaggaaattgaagctcaagaaggtgaagatgatacctttctaacagcccaagtaagtttacatttagtcctatgaattcgatattgtgggtggacgggcttggaaaaggaatcttattttgacttcataattctttaattcatataactgtcttaaatttaatactgagttatttacgtgatgtacacaaagtacttaaaactattggcaaggtcgggcgcgctaggtagctcacgcctgtaatcccagcactttgggaggccgaggcgggcggttcacgaggtcaggagatcgagaccatcctggctaagatggcgaaaccccgtctctactgaaaatacaaaaaattagctaggcgtggtggcgggcacctgtaatcacagctactcaggaggctgaggcaggagaatggcatgaacgcaggaggtggagcttgcagtgagccgagattgcaccactgcactccagcctgggcgacagagtgagactctgtctcaaaaaaaaaaaaaaaaactattggcagctgaaatttttgttgccagaaaaataattggagttactatgagtttcctgtcattttcagagttttagaaaaaagtccatcctttctgtaaaacctaactctggttactagtcttttgagaagtctacattcttcttgatttttttcttgtcacttgatataaaataagtcatttaaaagtactaatatccttttcaaagctttatttgaaattttgttaatgtaacactcctacaacaggcatagtctaaaaatgattaaaaatttctagaaatttacttggggtgtgtgtgtattgaaaatgactgcacttcactgtgtaacaacgtgttgctgctatatgtgatacacatagtgtacattttaaagtgacttacagatgctgtaagcagacatctatagatcagtttctacataaaaattatccattgtctttttctcatatctgtgactaaagaaccctttgtttttgtgtccttaattttttatttttatttttaatcttataaaaaccagagagggtttggtggttttgatctgagttggttttcatctgataaatgcatgcatcccccgtgaagggagtcagcgcccattggtatgtgttagctctagaattagcacagttacccaagtaggacaggattatgtcctctttaaatggtgtactttcaaatagagatatgggttcctttgtttactagattcagaaaaaataatgaggaggtcagttatttcctctgggtagtatttcctagaagagtacttgggcttgtgtttgtggactacttagttgattgtctcagcatgctttcttttctgcaacactcttgcctttgaaatgctagtgagccacaaatgcttctgaggctatatattgcctctctgtcacagtggaggagaagttgtattttggagaaaaattgcatttctgggagaaatgttgctgatcatttggaatattcgggaaggaaatattagaatggtgaaagtctgtaggcctgtccctaagtacattgatttcctagtgataaagaatctatgaggggccaggcatggtggctcacacctgtcatcccagcactttgggaggccgaggcaggcagatcacaaggtcaggagttggagacaagcctggccaatatggtgaaacctggtctctactaaaaatacaaaaaattagccaggcctagtgttggacacctgtagttccagctgctcaggaggctgaggcaggagaatggcttgaacctgggaggtggaggttgcagtgagccgagattgtgccactacactccagcctaggcaacagaccgagacttgtcttgaaaaaaaaaaaaaaaaaaagaatctatgagaaaaattaactctcaaattgagagagtaccttttctagattactgatttgcaaaaaggggaagtcgaggtctttatattatttggcagctagatattagcttctgtcaaggactactcctatagttttgcactttgtgagttgcatgaaggcatcatagctaaggatccccacttaaataataaacttcattacgaacaatttttaaacagatggaaatatatctgaaggaagaacagttatgtatttcttatcagggagcaagattttgccatattgtatcaaaagatgaggttacatttttagagaagttttctttaaaatgacctttttcctctttctaaataatgtctagtggaacatctagaaacataaatgtatctaggttccattatgatctaatgcttctaaacatgcttactgagtatattactatgtgcattcagggatactgcatagtgtaacaatcacctcgcttcagctgttttcaaataatggccagtcttattttcccctatgcctctgtttactttctcccttctgcattattttgaaacaaatccaaacatatttcccttgaaaattttcaatatgtatctctaaaagagaactcttattttttatattagcactcctaaaataaaaattttaatattatgaaacatacagttaggattcaaatgttcaattttctgtagatttttctctattatatgctgtttaaatccagataccagtaagatctgtatgttgtgattgattgaaatgttttaggaggttttcccttccatctgttttcctcttactattttatttgttgaaaaaagcaacttgcttatcccatagagcaagggttggcaaaaacaggcatctcatgtagtttgccagttgctgctatagagcttccaaggcctggattttgctgattacattcctgtggtggtgttcaacatattcctttgtttattgtattttttgtaaattgttaaggtggttgtagcatctagaggcttgctctcagattcagcgttaacaccccactccagcacacacacagccacctcataggtgtagtactgtattcttctatttggatgcacataatatctggttgtctttttgtgatggtaccagtcattgatgattcatacccaattaggggttgcagagggatgctattctaattctatcattcttctttattggttggactgtttctagaaagagaaactttcccttatttactatttggttacccagtggtatcatttacacaggaaagccaggatatatgtttgattctttcctttttatttaccaattttcagaatattgagctgcttcactggcatctctgacagtggccagttagttcttaatttttccttttttcccctttagattcattttgaactcatggatttgaatatatgtaatgtattttggtccatcgcagttattatccttaatgcttaaattgttccatacagtgagagcctcatcaagttggctcttgagtcttctcaacatgatcctagtagactttgattgattccttgcttgctggtatgtaaagatgtgccatttcctgctctagacctataattaggcatttcttctttatagtggtaaatggtatttcaagacaacaatctaggtggtggaggtgttcgctactactgaattgttcattgtttctaggtcttttcaatgtacaatgctagagaaaatgttggagttgttttctttgtttttgcttatttttacttttaagataaaatagaccttcaattcatacgttagttccaagataaccatttatctcacggtacacatacaacaactttagaatgataataccaacactaccaccaatgtagttactgaaagtaatttaagatttttttaagacatattttttgcaagggtgtttccctctggggatgaacactgtgttttaagttctttccgttctgtgtggttgtatcacccactgatacatatctaggttgatttgtttcatttattttcagtatttaggtattgcttttgaaagtttagtctgggctgggtgtggtggctcctgcctgtaatcacagcactttggaaggttgagatgaaaggattgcttaaggccaggagttcgagaccagcctgggcaacatagtaagaccctgtctctataaaaaaaaaattttaaatagctgggtatggtggtctgtgcctgtagtcccagctactcaggaggctgaggctggaagatcacttgaccccaggaggtcaaggctgcagtgagccaagatcacaccactgtactccaacctgggcaatagagcaagaccctatctcaaaaaacagtagaaaatttaatctggctggatgcagtggctcatgcctgtaatcccagtactttgggaggctgaggcgggctgatcacttgagctcaagagttcaagaccagtctgggcaacaaggcaaacccccatctctacaaaaaatacaaaagttagctgggtgtggtggtgcacacctgtggtcctagctactcaggaggtagaccgaggtgggaggattgcttgagtccaggaggttgaggctgcagtgagccgtgattgtgccactgcactcaatcatgggcaacagagcaagactctgtcttaaaaaaaaaaaagaaagaaaaagaaattatgtatatgtacacacacacacacacacacacacacacacacacgcagcatgtttatatagggatatatctatttcaggagccagtcctcaggctttgactagaagttaaaatctttaggcattagcctctaggaagttatactaggtagactttagttcagattctacttctattagttaattacaatactgtgattgtggcaggttctctattagtcaatttctatgtctacaaaatgattataattcttactcagttgatatagggattaatcatagattctgatgtagtatatgtgcaattagtagtcatttgtagtgttgttttactagcttgaatatactgcttacttgagaagtttctggagctttttctctaaaatcttgtttgctaatactttaattttgttgttgttgttgttgttgagacctggtcttgctctgtcgtccaggctggagtgtggcgacgcgatctcccctgactgcagccttgacctcctgggctcaagtgatcaccgcacctcagtctcctggtagctgggactacaggcgtgcgccaccacacccgtctgacttttgtattttttgtagagatgggggttcgccttgttgcccagtctggtctcaaactcctgagcccaagcagtccacccatctcggcctcccaaagtatttggattacaggtgtgagccatcatgcctggctttaatatgcttttattcttaaaaatttcctctagtttcaagaacctcttcagtctataacatcatgtatattcctttttctatttgcctttgcacctaatgtttcactaacatgaaaaatcttactttttgttatataaaaatctgtatacctctcacagccagattcacctcttatctcctccacaaagctttctttcatctctctcttttatgtagtgctttactattcacagagagctttttatatccattaccttactcaatccttgatatatcttatatggttcacatgtgaactccattttataggtaaattcatctagatagatgacatatcacagagtaaaactatttcagtgataacgacagggtaaatacctaggtgtgatgatgcctagtctgatattcttttcactaaataactccacactaggaaatgttttctgagttctatcgtacttaacatagtgccaaagttaagtgcttcagatacatgaaaatcaagcagttagttcagtctttccagctaaaaacagcagtcttacactacatttatttagtaaattcattcaacaagtattttttgagtacttatgtgccaagcattttgtatttcccatgatgtttagcatattccccgataggtaagtagtggtttaaaagttattttgaaagtttgttttaaatgtcagtctgaatacagtgtttacatttcaagccaggggaaaggaggtcttcttgcttagcctatacatgtacagatatcataagataacctatggggagtagtagaattggatatgtagtaaatacttggttcactgaaaaataagtcctaggcttgtctttgtctcttagtagtcattgctgcttctaggatgaaatgaaagtaaataaaggagctttatgtattttagcatttgactaaggattgcacatcccactgtgaagataaacaacatgagtacttaccttgtagacatttgcttcatcttcatatgtgaaatttttttttcaagacaaacttgagtggttaatttaaaaagatgctttacatttgacaaataaatgttttacatttacttgctatattcctcatttggaaaaaaaatctgttttcagtgggagaaattgttttcaaatagttgcatatcatgtctgtgcatatataccatttagacagggaaagtttcccattgtatttcttggtttgtttccttattgcaagtattttggattcttatttaggacttatggttagtgctatgcttgctgcacatactgcacagtaaaatcaataggcatttacgtgtggttcatcttttctactttacccaagttgtttttgtgctccaaccacattgtaatcagttttgttttctagaagctgggtcagaccatttcctaccggcatataaatgtatgtcataaagtttgcctttaaattatgaaacccttcagaagacatgctgaattattaagataaatatctaaaaattctccagcaagtaagacaaaccttactagttactttagcaactagaaataacattataattgacaggaactacaatagaatacagtttttttttttacatcatagtatttttactattttactttttaaaatagccaataatttggacatgttatgtttttttcttgaagctatcagttttgcatctctaaaacaataacttggaagtggtgtgctcttcgcatctgaggtagataaggggagtcaaactgcattcttttttaaaaaattatttatttttttaaaatatatttttctaaaatagagatagggttttactaggttgcccaggctggtctcaaactcgtggcctcaagcaaacctcctgcctcagcctcctaaagtgctgagattacaggcatgagccaccacgcctggccacatgttgcattctttaagttaatttagtctgctttaaatacaagctcaggtgtctcagtttatttattccttcaacaaaaattactaaactaaaagagaatgtgaaagaaaaagatttatccataattcaagcataactcattctttccttgctgtctctgtctaccattccacccaagttaaagcgtttttctttcctttccaaatattgcaaattggacacataatgcttaaaagtaatattctagtaaaacaatttattaagacattcttacaggctgggtgcaatggctcctgcctgtaatctcagcactttgggaagccgaggcaaaaggatcacttgaggccaggagttcaagaccagcctggccaacatggtgaaacaccatctctactaaaaatacaaaaattggccgggcatggtggctcacgcctgtaatcccaggactttgggaggccgaggcaggcggatcatgaggttgggagttagagaccatcttggccaacaaggtgaaaccccatctctactaaaaatacaaaaattagctgggcgtagtggtacgcacctgtaatcccagctacttgggaggctgaggcaggagaattgcttgaaccagggagtcggagggttcagttagccgagatcgcaccactgcactccagcctgggaagcagagcgacactcagtctcagaaaaacgaaacaaaacagacaaaaaaaaattggccgggtgtggtggtgcatactgggaaggctgaggcatgagaatccctggaacccgggaggcagaggtttgcagagagctgagatcgtgccactgcactccagcctgggctgacggagtgagactctgcctcaaaaaaaaaaaaaaaaaattcttagagcacagtataatggtcttagatagtgatcgaatttacactgttatcaattgatcatttacttgttctggactattttacttcttagcttatggccgagctttttagtatttttagtttccttcatgttactttagttgtaaaatagttagtcattccctaattggcacactttaacttagtccaaatatcatttattaataaaatgacttcatagaaattattgttggccgggcgtggcagctcatgcctgtaatcccagcactttgggaggccgaggcaggtagagcacctgggctcaggagttcgagaccagcctgggcaacatggtgaaaccctgtctttgccaaaaaaaaatatcaaaaaaattagccaggtgtggtggcatacacctgtggttccagctactcgggaggccgaggccggaggatcaacttgagcctgggaggcagaggttgcagtgagctgagatcacaccactgcacttcagcctgggtaacagagtgagaccctgtctctcacacagacacaagtttgaaaaagaaagagagagagaaaatacttaaaaaaagaaattattatccaaatgtacttttgagcacattgtaaaatatttgacattttaagaagtgcatgcttttatatgaatctaaaattgtattataaataagctgtttacagttctacgtacatttccatttttttcgtcttttttcactaaggttgtcactctgtaaaggcagcaatgctcagtgtttgcgctgtaccagcagcattagtttcacctggaaccttgttagagatgcacattctttttttttttccattttaatctttttattattattattattatactttaagttttagggtacatgtgcacaacgtgcaggtttgttacatatgtatacatgtgccatgttggtgtgctgcacccgttaactcatcatttagcgtcaggtatatctcctaatgctatccctcccccctccccgtcagatgcacattcttaagcctcattccagaccttctgaatcaaaatctgtgttttgttttaacaagccctccaggggattctgatgcatgctcaagtttgagaaccactgctctaaggctttgtatgtggtaattttacaacaagcttcacatcacctgactttaaacagcgtacttctgcttagttttctaagcagaagttattaaaggccaggcacgctggcccatgcctgtaatcccagcactttgggaggccgaggtgggtggatcacctgaggtcaggagttcaagaccagcctggccaacatggtgaaaccccgtctctactaaaaatagaaaaattaggctgtgtacggtggctcagcttgtaatccaagcactttgggaggctgaggcgggtggatcacgaggtcaggagatcgagactgtcttggctaacatggtgaaaccccatctctactaaaaatacaaaaattaactgggtgtagtggcacacgcctgtagtcccagctacttgggaggctgaagcaggagaatcgcttgaacccgggaggcggaagttgcagtgagccaagatcgcaccactgcactccagcctgggtgatagagggagactctgtctcaaaaaataaaaaataataataataaaaaattagctgggtgtggtggcaggtgcctgtaatcctagctccttgggaggctgaggcaggagaattgcttgaacacaggaggcggaggttgcagtgagctgagatcatgccactgcactccagcctggtggacagagcaaaactctgtctcaaaaaaaaaaaacaagacaaaacatacaaaacaagttattaaaacatttggtagggcacagtggctcacacctgtaaatcctagaactttgggaggctgaggcaggaggaacgcttgagtctgggagttccagaccagcccgggcaacatagcaagacctcgtctccacttagaattaaaaaaaaaaaattcgctggacatggtggcacacatctgtagtcccagctactcaggaggctgtggcaggaggatcacttgagcccaggggttgaggctgcagtgagctatgattatgctgctgcactctagcctggacgacagagtaaggaacctgtttaaaaaaaaaaaaaaacaatcaaaacatttcttaagccaagcgtagtggtttgcatctgtaatcccagctacttgggaggataaggtgggagaatcagcttgaggccaggagttcgagaccgcctgagcatcaatagcaagacttgtctctaaaaaataaaatgattctttaattttttcagttattgagattataatgcatattactttattctttatagtcttatatttgggaaaatgttggttctatgttggtttgattacttcagtgatgtttgcattatttgcttggtagaacaaattaagcttctcccttccctttatgactcttctgtttttaagctagcacattcttaattttaattttagccaaactgtcaaatatgttaaaattaaagtcatattttaaaaatgtgagggttaacttgttttaattacttgtcacacaaataccattttaaaattggctttgccatcggtatatgtgtgacaactatgaacttttttttttttttgagacagggatttactctgtcacccagctggagtgcagtggttgatatgaactcacttttaacacattaaaagaatgaataatttgaaactgacctagtaactgttcttctaatgtctgatatacttaaaggggagtattgtttgtttgtttggtttattactgtgtattcaagcacttgaaagttacgtctacagattatactttctggtactgttttgaatagtatatcttagctaagagtacctgtgaactgagtgacgtaaaatacgtcatcaggtcagccttcttattgacagctctttgatatgaggaagaattggattatataaactagttttgaatagtgaaactaatccagtttgttatttatgtactcattgatagatatacctgttttctaaaatgtaccaaacttgtgccacatatctctctacatggactctggttctgattggaatagcctatttatttgttagtgttaggtatccctaaataatatcattaaattatccaccaattttaacttggctgattttgtactattactaaaatctagttttatgtgaattcattttacatttgattattctttgaatttcaggatggtgaggaagaagaaaatgagaaaggtatgtttgatgctagagcttaaaaattgctaaaatttagaaaaacagtaaattatgtaaaaagcactccttatttgaaatcttatttttgaaattagtttattttcaaatttatccatttagtgaattaagttagcatcttgattttattttccaattggttttaattttcttttgaacactaaagatatattgcaacttaatagtacatatcagttactgtagtgaacaatgctattttttatttaacccaattttaattttatttttaaaataacttctggtatacggtaagttgattaaattcttaagactgacactgcagtaactcatgtgtgcttattggagtcctagtgcataactcacagtgaattttacaactagtcctaaaaatgatgaatgaccaggagactgactttgtgtttgctgcttagagaaacttccatacagtcgtctgacaattttagtttagacgagctgtctcattcaatacaattacaggggcaacagtagcaatacatgtggtcagtaggaggttatggaagagtccttggacagaagtcaaaggatcctactttggactagaaaggacatggagcagggttaagcaaggcaaataaaaagcctagaagcagtgatgaaatgaagctactgactgaaaatctcacatgcccgaagcctttctgttttgggggaatgcaagacatctttgaaaacggtaattgcagactgactggacaggatgaagactggaaataaccaatttcctgaacgtcacggagcaggagcatctttggagccttctgtaccagttttccctacgaatccggactactcaagcattgaagagtggaaaagatggggctctgaaatactctgaagactgattgatatcctcagactgttacctgtcaagaagtcaccatgggagttctgaaggtcactagggttcaatcccaggataattccagcattgaacaacaatctgcacttttgtcactgtcacatggaggaacaaaatcttccatatgccattaacttataaccagaaatgaagagctggtatcttcaggatggaaccattttctcactattgttgtttggtgtttgtatgtagagatcattttttccatgaagaataagtgatcctgggtaaaggatggtttatgttagttaatacccttgtgttttttttttttttccctaacttccatcagtgctaataactggctttatattttctaggtcctattctagcttatgaatatgaaattgtttaaacttcttgttttgccatatttattcctgttaaatcctcttagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagaggtttgtttttctatgtcagttctttacgatactgaattccagcattcaataagatcactctacattaagggggtggcttcaagaacatgtacagtaattagtgtcttatgatcctgcctataatatttttgaccgtcataagttacttttaaaaattttcaagatcttcataataatgcagtgtgttctactgattgcattgtcgaatgtcagcatatatttggtttttttgttgttttttgttttttgtttttttttttcaaattgacaatttttttgtgttttattttttaaaatccttgtgatgatggttaatgaacaactatcagttctaagaacacaaaatgaagtcaagtcccagtcctgaaatctggagaagatggccatatttccactgaatagaattgtcagaaaatctagatcttcaggcatcttggggaaaatcagtgcaagaatcctcagggagtcatttgttcaaataacctaatctaggcctttggaattgttaatttgtatgaatagcactagtttgaaatatagtaaatatcaagctgttctgttttgggtttgtttttgtttttgttttcaattttcttctggtgatttgcctctttagctcttcaaaggaatctaaagacagcaagacatcatctaaagatgacaaaggtaaagaatttttttccctatttatttcagtgttgacattgtgtattttcattaaaaagtagtagttgcgcggtgttttctttgacatttagtccttaaaaattttattgacagactagaaacttgagatggtctttatataaactgtggaattatatatattacagaaaactgattgatgtgttactgtttactttgtaaactggtaatggggtacgttaaaaacccattagctagggaacacttacctggtgtgttctaagggactgtgttgaatattaatagatactttcttacattataatttcagaactattttatcttttgttactcatttataactactgtgtatcaccacaacctttttcctgttctgtctttaaataatacttgtgtgtatttgtggagtctagtgttcttttttcttttttttaaattcttgtaagtttcaaagtgcaatatttagttgctttctgatactgagaaatctctggttatctcatgcccatgagctgtagtttcatcttgtacatgtgctgtgtttacttgaaaaatacttaatttctagaaaaggattttaagggaaaataaaacattcaggtactgcaaagcttttaaatacctcctaaatgtgtaaaggagaattgtatgcatcctccatagtttattttaaatcgttagaaatcataaggatgtgatttatgaattggttggtcttgcttaaaagaatgtgaaatatagaaattgttccttttaattgcttgtatactgtttctcttaaagtgagtaaaaattattttccaaataaagtcaagtgaatg

SEQ ID NO: 224 - DNA, 11403 bp, Homo sapiens
aattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccgcggaggtgtggtatcgccctactctctcaagagtcggaaataagtatcctggtcctgtcggtgctggaacccggcccctcccctctttgacagctttctgcttgtgtcccctggattctccagctttcactttaataaacccagttttgccctccttgcggagcgattatgagttctagtgatgagaaattttttatttttctaagtaaagcgccagcagtgacccatttattttgatctatttatctcgatcttaactcatggtaatgctaggttttaatttttaccccaagctaccgctccgtcttcctgctggaaagtggtagtttagaaaaagtagtgattgaagtcccaaaggtttcactagttgtgttctaattgttatttcatgaaagagaagcacttctcgtgaatgcggttggaagaaactttcttttaaaaatttagacttgaggcccggcgcggtggctcacgcctgtaatcccagcactttgggaggccgaggcgggcggatcacttgaggtcaggagctcgagaccagcctggccaacatgatgaaaccctctctctactaaaaataagaaaatcagccgtggcgcgagctactaaaattaagaaaatcgtggtggtgcgagcctgtaaccccagctactcgggaggctgaggcaggagaatcgcttgaacccaggaggtggaggtggcaataatccaagatcacaccactgcattccagcctgggtgacagccagactgaatctcaaaaaagaaaaaaaaatttttttcgacttacagtttttaagaatgcaactttgctggaatgggaaggaaagatttttaaatatatacgaattgaccttttacaattgagaacaaagcatacaattttgtttgataattatgcatataaatgtactatcaaacactttatatttgtatatatgtatattactttaggatatatatgagatgggaaaataaaaaccagaggagcaaaatgctcataggaagagagcatgtccttatagttccacagaactataaagaataaaccaaagcgatcagcatcagatttcatgcttctgaatgttcagtattatttgcattattttatttcttaaggaatttattcttctagacaatatccagtgcagatcagtcccctgacccccttcatctgccactctccatcatagttgtagtctacttcctattttgttttgactggcatttaccaaaagtgaagcatactgaaacaaggacattcttgttttggaatatgggagacgtgatttgttgtgggaactctgaattatgcccatagtctattgactggttttgaggggactggcaaacatcccttgttgaagaatgagagttatgataggagaaggatttagactccaccttatccagatatatggaaggtgaaaacaaatagtgatgatagtagaatatgaataaatccttacaagctgattagtattcctatagaggaacgacatattgtcattagacacttgaagagagaccgcaaaacatcaagtggaaacacttttattgactactatctcgttttaaattgtggctatcctcctgaatctgtaatttatgatgtaactggatgttgtgtttccatctttttttctaagtgtcatatatagctgtgatgacaccactcatttttacccagtggttctcgactgggactgattttgcctccagtgaacacttggcaaaatgaagacattttggttgtcaaactgaggagtatcactgacatctaatggatagagaccagaaatgctgctaaacctcctacaaatcacaggacagccccctgcactcaccccctcaaaagaattacctgcccaaaacgtcaatagtgccaagattgagaattcctgtttctaaattcaactaataaattttaaatgtgctttttttttcctatgctacagttaggctctgggggttagaatagtcttttacatggaggttaggatttaaagtcagcaataaggaagaaattatatacagtattttctttttcttctattgaatatatagtattttcaaaaaaaaaatttcttagctttcccatgaaattcagtgtgaatagcttcatggacatgctgagaggcacattcgaacagaaataaatttttaaaagaataataatagcagacacttagtcaccacttactctatgtacagcactgggctaggcagttttgttttgttaactattagctcacttaatgtgttcaaaccttagaaggtaagacatatttttgttctcatctttcagatgaggcagtaagcctacctaactaaggtcatagggatcgtagctggtaggtagagctgggtatcatacctaggcagtctggctggcctgtgttcttaactgttatatgacccctatttatacagattcatgtggaatattgggtagaattgccaacattatcaattttcctttcttttttcccagttcatatagtcatgtgccacataatgacatttcagtcaacaacagaccgcatatatgatggtggtcccataaggttataatactgtatttttactgtaccttttctatgtttagatatgtttagatacacaaatacttacattgtgttacaattgcctacagtatttagtatggtaacatgctgtacaggtttacagcctagtagcaataggctatactatataggctagatgtacagtaggctatactatctaggtttgtgttactatactgtatgatgttctcccaatgacaaaatcacctaaagatatatttctcagaatgtattcccagtcattaagtgatgtaacttaggaatgagtaggatgtaactgatagtaaaaagttgcaaagccagtaaaatatggcacatccaaatggttaaaatgccatgttccattgtttctaagaaactttatttttacattttaacattctaaaatcaggatacatcttaaaatccatatgtcaatgggcagcattttccaaaaaatgattagtatgtgaggcaatacatgttaattagcttgatttagccattccacaatgtatacatatttgaaaacattatgttgtattaaaaccatacataaataatagtgtatattatttttattgccataaaaatcacaattacttttgtacaaacctaatatgtgataaatatatacaactatttgtcaattaacatgaaataggcagcatttttttctttcttggttgtgcataaaatagtcatacatataatagttgatgctatcttagatttcagacaccatatgtaggccttctctataccctgtttgaagctatagacccttgtttgtccaaagcagtatttgttcatatgtatttaagccagtacactggagagtttttgttaaacccttgggacctgattttgccaacttttcattatgtccttgtaaggtttccttaccttgttttgagattacagagacactgaagttatatctggtatctgtaagcaataaacttgatattttatttaaataaatgtatctcttaatttattaggaagaagatgctcggaaaagaatcctgtgtcctttagatccaaaacagtaagtgtggatcagatacgggtttttttttgtgctggaaacagtaattggcacaagtctcatttgaaataattttctctttaaatttagcacagtatatgaagatcaactagcaaagcatttgaaaaaatgtaactcaagagagaaaccaaaacctgtaagtgtttgatcagtaaaattgaatggtgaaatgtggtatgtaatgccttggtagatgctgcacatggaatgtacttgtttcatagctgaggaacccaagctcaggaaatataatttttttttaaagagatagggtctcactctgtcactcaggctggagtgcagtggcgtgatcgtagctcactgcagccttgaactcctggactcaagcaatcctctcacctcagcctcatgactagctgggactgtaggcaaacgacaccacacctggcttatttttttatttttttatagagacggggttctcgctgtgttgcccaggctggtctcgaactgctggtgtcaagcagtactcctgcctcagcctcccaaagtgctaggattataggcgtgagccaccaaatccagccaggaaatacaaatatttttaaattgggtagtaggcaaacctgcctgacttttgttccataagtagacatttatttattacactgtacaataagggctgccatgcgatccaggaggtgacaccatttctgtcttccaagggtgcttggtatacaagctcccttgaaaaggtagtctgggaaaaaagataatcagtgcctttgcttctaagactcatagaaaatcgagacttatgggaggatgtcttgcaatagcaccgctcagttactttgacaacaaaatactcccattcatttccaaatgcctcccagttgagaaccactgggccagatggcataagtttagaaagtatttttacattaagatggtgtagaagaaaaatgatgaccctcaccaccaccacctacttaggacttagcccctttaatagaaagagagaacattggctttgtttgcaaatatcttccttacctaagttccaggtttcagttaaagcaagcatgtgcaatatgtgttcagagaaaagtttgagaggatagataaatttattaaaaatggaaacccttgggtgagtttcactgcataccaacacacagtggcaaggaaatggagaaaagcggtggaatgatgagacgaagaaagaaatgcaaagcagtatttatctggttcactatgtagagtaggacacttggaacccaggtaaaggcatatcactattctgctttactttgggaaactggtgaacaatttttttaaattttgtatactaaataaaagttagttggttataaatttctccagtataaatagttttcacatttaaaaatctaatctacaacgtaagttacctggagcactcttggcaaccattttgaactaagagtacatcaaattctaatacttaacagctagttttctattatagtttttttccgttatccagtaaaacattgtaattcctgcagtaaaacattgtaattcctgcagtaaaacattgtaattcctgcagtcttcactcattccactcaatcaccagtttccattgcaagcaacacacattctgtccatataggtaaagctagcaacacacaatcaggatgttacctttctgcctccatgtaacaaaagtccatttactacacataacataatgtccccaagagttattttcacttttgaaacaggatttgtagaaacagtactttttcattcatctagatccacaccgttcagtatggcagccactagccacatatgactatttaaatttgaattaaaactaaataaaattaaaaatctagtttctcagtcacactagtcatatttcagtggctgccatattggccagagcagatgtagaacatttccatcattgcagaaagttctgttggacaatggtaatgcagatccttacctagaatctgtatttctgaagccagactagaaagatttcattatgtgtgtttgtttgtttctttgtttattttagagacagggtctccctatattgcccaggctggtctcaaattcctgggttcaagggatccttctgccttggcctcccaaagtgctaggattacaggcctgagccactgtgcctggcttcattacgttaatttaaatagtgtgacaggacatttatattttcaagttttaattaatattttaaaatagaagaaatcagacttattgttataatatctttgtcttatctgtttttggtcatgctgcatgtctgataagcagcattgtgtagttagtactttgctgtttttactttagcactataagacaaaattattacagttctcagtgtatgctgtcaacagtctaggctgtagaacttttaataagtgttacaaatgaatttctttaaactgtaagtgcttattcagataatcacctcactagaatataagatccacgaacacatatttttgtcacttttgttatctactgtggtggagtgcccaatacctaaagcaaactagggcctagagtaaatattcaatagtgatttcatgaagaaatgaatggaggaagggaggatggcaggtacagagcaggggataaagggaagaatcagtattttagtttaatttttgtgagctacacattattaacagttcttttatggttttgtttttgttaaggatttctatattcaagatattaatgcaggcttaagagatgaaacagaaatacctgaacaattagtaagtacattgacttaatatttaattttaaaagatatttataagctctcttcatgatgtgaataaggcatgttctaatttttgtctcaagtctgtttttaatttagaatgcattttcctgtagacttaatattgttagtgatggttagttcctagacccagaccagctcatgccccataacaaaagaagctacaatatggccctgaatcccctttgattcttgaacccttctgagcctagacttgttcttgaccttgaggaagttaggaaaattaaagtagcacagcaaagacggagtagaaatttagcagttggacaattctgatggcagcttagggaaaaggcttgatagagagaagagcctaagctgtcatgggatttgcccagttggtaaacctctactcagtctctgttatgctactttaaagcaatttttggctacattatttagttttatttttgtatataggttccaatttcttctctatctgaagagcagttggaaaagttaattaagaaattgagaaaagcaagtgaaggtaagactgcctaaagttgcaagttcaattattttagagtaattaggtggtatatgagttgataccattctggtttaaaatatgttactactattgttcagaatcctacaattacatgtttggctgcttaagctgttgtgcttatatttggcacaggcttgaattctacacttaaagatcatattatgtcccatccagcattacacgatgcacttaatgaccctaaaaatggcgattctgcaaccaagcacctgaaacagcaggtatgtttaggctatagtaactactaaacatggcctttgttcatttgttaaaactgttttaaatgtaattattaataagattttattttgtttacctttgagggtaccaaatatttccatttcaaaaatatatagaaacatatacaaaaaattgagggcatggatgtgattctgagtaccgtatattaaatatttaaaggcaagagagaaaaattttaagtcaaatacaaattatcaatgtaagcatactgccttatgcagaaattaccttgctgttttcccatttgaaccaaatgtgtttactctagtttataaaataatcttgtgaagtttgcaggcttctattttaggtaacattgaaaatttaaagttacttggtccaagaagatgctttgttgagtttggagcgggaaagggaaaattatctcattgggttgatattgccttaaaagatgctgaaaaagttcacttcatcctagtggaaaaggtgaccacaagattcaaggtaagtgaaaccattgctctgtgttagtaaccaaacttgttttcattttttgtattcaggaaaaaagtgatagaaacatttcttaaaagaaaggaaaggaattttctttatctgtttgttgtagctttttattagttctaattgtattgataactcaaactgaaggtgaattttttaatctaagttttgatagtccattgatctgaattcttaaaattatttgcagagacaggaaaatatatagaaagagccaagctcaagctaggagttaaaagtcttgggctctactcctatctttgccacttgcccttcattcattaaacaatttttgagcatactgccaggccccacccaggctgaagtacagtggcaggatcgtggctcactgcagccttgacctcctgggctcatataatcctcccatttcagcctcatgagtagctgggactatagtcccacgccaccatgcccaggtaattttttaaaattttttgtggagacagggtctcactttgtcgcccaggctggtgtcgaactcctgagcttaagccatcctcccaccttacccttccaaagtgctggaattacaagtgtgagccactgtgcccagccactttattacttatatttagaaaagagacccaggcaaatacataaatgattgtagtgaagtgttaaaatacgagaaaggtctgcacagagtacagcatggtttcaaagaagggagtgacaagttctattgcagggaagagatggagaatgactatgtagaaaaggtgatgcttgaactaaatcttgaaaggtgaattggtgtttgttagagagtttgagaagcattctaggaagcaagaacagtgtaaccaaatacctgaaataacaggaaaatatggaaacattcctgtataatgggagtacatggtgcaaagtagagttcagcaatgatgggactggagaggatggctagcctatagaaggtctcatattttatgctaaggaaggagtttgactatgctgctgtctggtggggatacaatagaaaaaagatttagttcttggctttgaggaagcttacgtctagtggagtagacatataaatatttgtgttcagtatgctaagtgtgttttgatagtggtaagtacccaatcctatgggagcatgaagatagagcaccaacctcagtctagtgtgggtcatagaagtttttgcagaagtgacagttgagatgagattgaaataatatgtaagagttggtaaagtagaaggaaatttttcaaagtttatcctagcagcaccattaaaactatattagaagagtctgatacttagagagattaataataaagataatttttgtccaacaatccaagtaagaaagaggccagagctaaagctattgcattgggatggagaggagggcaagagtatgagaaatattaagatgttggaagccacaagagttggtgatttgttagtaattgaatatgagagataaggagtaattctcggtaggatttttatggcttaggtgactaagtggtgttctttcctgagataaggaatgaaggaggcacaagaggaaggatggttttggagacagaaataatgagttcagttctgaatgtgtccagtttgctggtgaagtagagctttctagttcacaattgagtatgtgtctgatgcccattggagaggcctgagccacaaatgtagatcagccggtcgtgggcacataggtatagattagaatggttgtgatctttcaggagagcaagaagaggagcgaaccaaaaatagtacaccaggagtgacaaagataaaggagctagtagacaatcttagataaatcacttaagatctgtgaacttcagttcctttgtcagtgaattgggaatttttagggttaaaggaaataatgtctatgtaataattgataaacattttcaaatcttttttaaaaagtgtgatattttgaagttctcatcaaagaatgtacaatcttaatttttaaatatgttctgttgctctgaattttgaaaaccaataaaaatctttttattttcataaagcttttttaaatgtaagaagtgattattacaataatgttctgtttgtgcaggtggatggaaaacacagaaagaaaaattcagtgtttgaaagacttcaaattgatattcaacacttgtgtttgagtaagttgtgtaactttccattggtctacaaataaatcataactgttttaaactctgaggttgcttagaaatccaatcatgcagaactgtgcttcagggaaaacagtcaaatcaattcattgttaatatagaatgttttatataatgtttttaaatagatgtaaattgaattaaggttgagaattttaaaaattttcagtatcaagtggaaatgaagtgttatattagggaagagtttaaaagttttataatatgtacttctgttgtttctttgtcctgtttaaattaattttgagtctgttcaaactataaactagccttctgcctgcagttaacgtgactttacctaaaccatgaaagaaaatgagatatttctctgcctagctaatgtgtaaaagatacttcctagaattttaaattgtacaaaagaagtcatcactgtgggattcatattccatacacaaaacacacacagacacatacacacacaaactcctcaatcaacctctgtagtgccctttttataccttttctatttttcagattatccaaagaaaataatgcaaacatatctttgcaacctcttccattcaccaattttaatccagccatgaaaagcaacccagcatttgtatagaaatcaatgtatttaaaattatttagctgaatatattaactttctgatgttatgaaccctaaacaagttcttatgttatatgttgggttccataaagtgataatttttgtttgagtctctttcaggctaaaattcagagactctaattagttctttcttttggaaggccacattaatatgtactttatttcactagacagttaattctcatttccatttcagacaagattcctgtgctaagagaagaaaaactacctgtggtaggaattggaaagcatctgtgtggtatggcaacaggtacgtaaacatactgataatgtttacattaatgcattaagttttggcctaacctggccccaaccatttcagtggtctcttttgaatagatatcttatgtttacaactcaataatctttatagagcactggccctgtgctttattagatgcatagctttcctatttatctgctcatattggccattttgcaggatgaattaagagttttgtatgtaaatactgcatcacattagaccttaaagttctttgggttaaatttcaaccagaaaaggaaaataagaccatttatggaaactgtatgattccacctagaagctactgattttttagagtagttgcttagaaagaactcagaaacctcttctactaaaagactattgtgtttcaggattctggggaaaaagaaaaaaataaatgttagac

SEQ ID NO: 225 - DNA, 113117 bp, Homo sapiens
atctttgaccatcagtctgtgacctgccccttctctttacgtaagtaaaagtgatttctttacctttaaaaaaaaaagtgtcagatttaggaaattgtggttttcactggcatatttcctagttgactttgttgtggtttctagtgcttctgtagtgtgtattagtttcttttgcgtttggagtgtatgctgttggtggtaatactaagttgctatccatgagggtgcagaaaataccagtggcccagatactgtacttctataaaggctgccctttacttggctgcagctgctgtttgcaaaagtcactgctcttttaaagtatagcttacattattcagccaaataccagcaacagttgggcttttgctcccctgtcaatcattgggcaattatgtattcttcagttatgtacccatccctaggtccaatagtttttaattttaacttctagatcagagctttcatttattgacaaaatttctaatatccctttactaagaagtacaagactgtaaaataaatagactaaacttttgtgcaaaattatgaagtctacaggggaaaaaaagaaatcccagattcacgtgtgccagaaggtttataaaggtaccactcttttttagaaaagatggaaaggtattcggggggaaaaaaaaacacgattttatatgaaaaaaaagagaacgttcattatttaaaattcaaaccaggctgcactgaatgggtttaaataaattttattttgaactgcttgaaaaagattctaggccaatgaacccaaataatcaaagtcacttataagagacaccacccaaaagatcctacaggtagtgatagtcacctaatgtgataaataattatcggtatcctctggctgcttctcactctctggtgagctctgttccttattcacaacattatatcttgcttcactgactcttcactccaaggtatttcttgtattataatcatttgcacagaatggaggttcccatggctattttgtttatgcgtgccttccactaacattcctagaagatagtggcaaatatatttagggaggcagaatcctccaaaggatgctaaggctaaagtgtaacgtgacagtttatttgacagagaaaggagattgattaaactccccaaagactggagctgtgtgtaatgcatttatacaacaggggtgggtcctacctgtccctgacaagtcttgttattctctatttcagtgttgatagagtgggtctgtaaatgctttggaggatgtcaatatgcatgcttatggttaccactttatatctgcacagccctcccctcagttacctagcactgcatatttctagtcctctgactggcaaatcatttttgttacagttcttttgtgtaaaaacagttcacataatagctctgtgttagacaaggcattaatcctcacatcaccgggatgagtcagcacagtgcactcctgcccgcacggctcagctattgtgacgtcagtgctatagggcgagcctcagacacaagcagtacaggggacctgtgtcaccaattaggaatcaagggggagacttttgagataaaaagtgtagttgaaaggctgtctctggctcataggaaaatgcaaatctgattctatgctacatcagccatcagttgcatagcttctagagatatcctattttttaaccacacataaggctgggggagtgacctataatgagcagataatccgttcatatacccatgaccttgtgccatccctgggccaggcttcatgtttgcttggcttgttccaaatcttgaagctgccctcatatcagcagggtgaccgggcttatgacagtcctactgtcctcaagtatcccatagacacagttgatggttgatggctccagagtggtgccccagaggctcgacaaaaggaaaagaaatgtccaatgtcccttgagaacagatcagaacattatctccccagtgctttgactccaagtgcctcttcaatggcctcctctaaacaggtacagaattctgcttgttcgatcttctcttagcagtgcatttagtccagtatcacaatctgtatttgacctggatttcaataggaactgaagagctctcagatgttcccccaagaatttcccattccattactgtttagcagaaacaaagaggaaccctccataatctgccatgctaccttgaagcaggtagcacagacttaccttatttgggaaacttggttcttataagttaggtctctatacaattcagattcagatttattctcaggacaatatctttcagtattgaatattaagtcttgaaaagggtgttaatttacagccttagtggcagtctctgttaaaaagaccttcctccatcacagaatttatccctcactcttactgtcaccccagccagtcaccagcccctgccatacccatcagaaagtgccttactgctgggatcttctgccttcattagattgctaatgggctcctactatgcttataaaagctaacactactacttggcttcgttttgattaattatcatgtacagctctttatttagttttcattcaacaaacatttatggaaagctagtcactgtgcttggttctggaaactccgggataaataagaaatgctttcttttgttagaaatctcagtctgataggggagatacataagtgaataaagactatagcatatgataggcactgaaatgcaggtatatacaagacgtagtaagaggaatgaaggaggagtgcccacttggatgtggtaaggtgaccaggctgggtcttaaagtcagaagagtaaattgcagtttaccaggtagatatgaaagagcagaaagaaaaggggatcataatcaagaaaaatgtaagagcatttacaaaatcaggaggcgttaagtagcagcgagattcagaggagtgaatagttcagtgtgattgaaacatggtggttgaaagagtagtatgagattgggctggaaagcaggcaggggaccttgcctgccatacggaggaccttgtatgccgtgcagaggagtttggacttgatcctgcaggctcaaggaggctttgaagaattgtaagcagatgtatgttttagaaagagcacttggtgaaagtggagaggctgactcagaatagggagaccaggtcaaaggtaaaagccaaaggcctgaactgtgcagtaggggtaggatggagggagaggctatttggtagtgttgaaatagacattaacctttgtgtaattccagcatatcttggcctattgcataatctttgccttctaggagaaaggctgaaacattgtgtggagtcaaatttcagaccaaaatacatccttatgggatcttcagcaaagacctcaatttgaatatgacctcactttgagctactgccccctggtcaccaggctcgcgtgcctcctactgcccatagtgggtgtgagggaggagcaggcagataaggagaagacattcccagtgtcctgcttgtctcttctttcacctgaaaatgaaacagtttctaaataatgcccccctaaagtcaatcaatgccccaatttcctatcattttctcattgctccctttttctaagcaaaatttccaaaccattgaactgaattgcaacttatgcacagccgggtgttgaaacaattcagtgtattcattccttctctctgaattagagttcaccataagtgtgcttttctcttgttcactttgggctgccaggacaatttaaaggaaattttcaacagcttatgtttcatgtactatgttctcttttgcaaatgggaggatatgcgtgggtgtgtttaagccttctctatattgctttctggagaaaggtttgggaagatgaacaagacgaggagtagggacctattgaaagcccaggtcccccagtgacctgagtgcagaacgtaggctggtgatcagatggtcaattatgtgtttgtcaaaacacagtgggctgcattccaggctgccagctttggaagcccagcttctgccaaccaaatgtcatctgggaacatgcaacactgggcactgtgaaggagtttgaaatagaccatgccacagccaacctactgccagtcttatagcaccaatatggcatgcacagccgggccccatgtttcagagctcaggaattcactgtactaaattcaagaggtcagatgggttcatgttttcaaagcctatgttctttgctttgaacactgtgacttgctcctcagcaatttccaagggatttttccagtcacatctctgtggaaaccactctttttgtgatggttataagatccttgtaaatgtcccagaggataggaaaaaaaaaaatcaacttgctctgacaatgactatgatttcgacagagggattccaactcttaggaaattacattaaaggtgcatagcttttaaaatatcaggaaccaccttggcaacttataaaaagcagaagggctttgcctattttataaagtgatttgcatatacctgcataaataatgtccccacctgtacttttatgcatttaggttgaataaattaaattttgtgatctttaaaatattcactgtctttcattgctcagacaccattttcaggacccttcctcctcatttcttttcctagtgataagagtggctatttttttttcaatcttttgactcattcagagaatcaaaacactctgaacaccaatcgactatagccaggaatattacctccctctggttgcatttctcttagcctttctacctatcagatggtgagttccatgtatttttaataagagaaataaagtattactaaggcgaaaacacagcacaagacagatttaagttctatttacatatatatgtaagagagagagagactgtgtgtgtgtgtgtgtgtgtgtgtatacacagacttgcactgatacacacctcagggacatgcccatagtaaccttttctttctttcaccactgcactgcgacaacctcttcaggaaccatccagctactaagccatttccgttgtaccttgggccttcaaatcaaagcctggtcagtaggccactctcccccacattcacgctttaagatattattaaaaacatgctatgtacaaagaataatttttattggatagttaaagcataaatataccataagtacatgaccctttcttgctcttaaggaatttaaaattgagttaggaaaaacagttatattgttgagcgttgtgtatgcacataagataataaatgactaagttccaaaaggaatgatacagtccaggaagtaccatagggtttcattcatgaaagagccttgcaggctagaaagtttcatgtaaaactgattcagctgagtcttgaaaactggctaaaatgtaaaaaagatgaagagaaacagaatcatattccaagcaaaatcatataccaaagtgttggaatcttcgagggggcccataaatagcatcacttttccccacttgaattctaaacctattgaaaaataagacaaaagaactgatagctagggaaccaaaatttttataaaggttggttgaagagcatagcttagtgtaaagaggaaatgggtttgctgactctcttcccttcagtcaaacctttcaaaagctctcttacaggaaaatgtggatctgcatatgagcaacactttccaggtcatcacctcccgatagtctcagtagaaaaggaaggacaaagaggttaaactcctgtgcttacaaatttggatagatcagttctacctacctgagaaatatagaccaagggctttcccaccaatgggatactttgcctccatggggaattataaggaatgagacaagaggaaagcagtgtttagaaaacatctggaaactaggagtagggaagaggcattcttacccacactgacatccatagactggaaaacaagaggaggaagtactgagtgagatgaaaatgggaaccagagccacatctggtctgagagcatatacctggggtaagaaccagtagtcctactggttatccaagatctaaactaagggccccttttcagagtctcaaaagttacaagaatcagaacctgggggaacaggcaagaaatgaagataatggacaaaagcctagttaggaaaaaaaatacaaaaactctagtttcttgttcaactaataataacaataagaaatacctattgagtgcttgccttgctttagatactggactaaatacttttcatggctatctgatttaaccttcaaaactaccctattaagtagatgctactataatcctaattgtgcagatcagaaaactgagatttaacatgtttgatttattttataagaacatctaataaatggtagagatagaacttgattccaggactatgtcttaaaagcctcagccaaattttactggacacaaagttgagtgtctactaaatactaaaggtatatataataaaggaatattaacatagtctctctccttctggagcttataatctggggaatgtaagacagatactaagcaaatggtctcacaatataacttgtaattacaaattgtgcttaccactatataataaaagtaccatgtgctctaagggcaaataaaagaagaagatttaactgagtctggaaattcaggagaagcttctctgaaatagtaacatttgagatgacacctgaaggttaaaaacaaaaagtaaggatggatggtggaagaggattccaggcagagggaacagcatgaagtccctgaagagagctgcacagagagaaaaaggtgactagcagcccaggttgaggttgaagagatacgtaaggcctgatgataacaggtccttggtaggccatgttaaggatttttgtgtttatcctaaggacagtagaggagcaaacttaagaaggactgtggcatgatcattgttgttttttaaaagggtaaactttggggcatttatcccagagagatggaaacataactgtacaacacctgtacattatgttacaccaatgtacatagcagctttatttgtaatagcccaaaactggaaacaacccacattttcttcagtgggtcagtggttaagcaaactgttatatctataccatggaatacctctcagcactaagcagaataaattattgatgcatacaataactggttttaatcacaagggtattacattgggtgaaaaagctaatctcaagatgatgtactgttacgattcttatctatatagcactcttgaaatgaaaaaaatatgtaaggattgagaacatacttgtggatgacaaagttagggagttgggatagaaatggaggtgagtgttgctataaaggataacgcaagggatcttttgtgatggaactgtcctgtagcttgactgtggtagtattcatgagtgtatggatgtaataaaattgctcagaactaaatatacactcacatactcatgtgcatataaaactgatgaaacctgagtaaggcagatggattgcaccaatgttaatttcctgattgtgatattgtactacagttatataaaatgttaccatttgggcaaaactgggtaaaaagaataacaaatctctctgtattatctcttacaactgcacgttaatctaaaattatcttgaaattaaaaatttaaaaatatatatcaaggtagcttaactttggtaaataatttggaaggatcaaaaatggatatgaggaaaccagtgagggagctattccagtagaccacataagaggcagactagagtattgacagtggaaatgggaggaaattgatggaactgagagataattcagaagtaaaatattcctggactttttcatggttggttatgtgaaataaaagagagaagtggcaacaatgactcctggtttggggcttatcaaactatatgaaggataataccattcacagttacatgaaacaccaaaggaggactggagtggagagaagtttgtaagttctgtttttgagatgttgagtgtgaggtactttggatagatacatagtgagcatattgcacaggtatttatatacataaaactggaattcagaagtaacatgaaggctggagacatgaattcagggtaatcgacatatagtggtaaatgaatctgttggcatgaataacattgcctagggacagggttagattgagaagaagacctaaactgagacttgaagagctcttaatatttaatccgctggtagaaaaaaatgaggccataaaataccctcagaaggagccaccaagaaggtggcaggaaaatcagaaaacataggcacagaagccaagagagtgcctcaaaggtagtggtcagtgatgtgacatgttactgagcaatcaagtaggttaaagactaacaaatatatattgcttatattaattttgagcttattgttgacctcagcaaaagctgttttgttgaagtggtcaaaacaataacgtgtttgtaatgggatgaggagagaatgagaagtgaagaaacagcaaatgtgggccactcagaagttttgctatgaaggaaaggaaaatgagctactgcaatatcttgaggggggaagtgaggtcaaaagaaggttggaaaagcatggaaacactagtattttttgtattttcatgggaagaataccgtagagaggagagatccaatgtgcagaagagagaagagcataggatgactggcagtataagattactgataaggccagagagatggaatcctgagtacaagtggagagatggaaggagggacacatcttctatttttgtaagaaaggaggagtaaaggaaaggagcagatgcaagcccacgtgtagatttggtactgaaaggttaagaggtttcccaagtgatgggcactgaggggcaaggtcctgctaagaataagcggggaagagatttaaggaaagtagagatttgaaatcgttcttgagacaaatgggacagcaagttgaccagagaaatacagtaggactctccttggcagtgtggaaggtgcaggtgagtctggtgggttgatgttgatacctatctgctctgtcatgggattttctccagcagtttggggaccaaggtgcaaaatcagaagaaatgagtttgaattaggatagggtttcacctagcatttgtggcattaggagttttagcttcttgttttggttctagctgaggccagtaagaaagggcagtgaaagggcttagttaaattctccaggcatctgttgagtatattgtatcaggcactgtgtttggtacagaaaatacagaggtgagtaagacaccatctatgccttcaaatagctcacagtccagggtggtttgtaggctgatatctggtccaaaacaccaggaacagggacttgaataacctttgcaaggaccaggagaccgatgtcattccttttctttcttatgcctgctccttccctctgccctgtcctcacaatacccagtttgtttttgtgttttggctttttgttttgttttgttatttactttctcaaaaaatatctactctctgccttattgccaagcctctagtatgcatcatacatatgtgagagacaactttgatttctcccattatctttttgctaaaatatgatgatttagaaacaattagatcatctacttgaagtatggtattggtatagtgtgaattgtctctaaatgttaagagctggcatctaacactacagaaaagctatttatttaagagggctggagacaggagtgtagacaggtgagagagggaacaagggaagaaagaagggagggatggaaagaagaggaaggaagcgggccgggcacgggatctcacgcctgtaatcccaacactttgggaggccgaggcaggcagatcacgaggtcaagagttcgagaccagcctggccaacacagtgaaactccatctctactaaaaatacaaaaaattagccgggcatagtggcgggtgcttgtaatcctagctactcgggaggatgaggcaggagaatctcttgaacccaggaggcagggattgcagcaagccgagatcgcaccactgcacaccagctcaggcgacagtgtgagactccatctcaaaaaatcaatcaatcaataaatatatatataagaagggtaagaaagcatattaactacacaagatcttatatagcagctcatccctgtttgttattcaagggaactcccatttaaaatgaataaataatcctccatccctaatggtgatctacaccatcagcctccaaaaacagcttccagacctagaaacgtaccagggtactataggttaattataaattccaggtgctggtaatgcaagagaagatatggagagggtctgaaggaggtggaagtttataacttccaacagaagaaagatcccttactcagatttattttaagcattataaaatgatagcttagaaagaggtggtggccgtgatggcttatctttatttgggcacattccattctgtgatattccctttaggaaatgatgttagggtcatttgactaaaagctaaattgctgatacatctggggtaaaatttggcagctgtcgagcaaaacagcttttttttaatatttactttttttatgattctataattcacacttattgtgaaatatttagaaagtatagagtaaaggggaaacatccataattccactacacagaaccaactattattaataattttttagatcaccttctagtgtcttctctagattttaacatgcctgagcatacattgcatgtatacagttgtatcccattttaattcaatattatataataaatacttcctggtataattaaaaactctttataaatagcactataacatctgaataatatcacataaagcccccagaatttacctaaccatgccctagataaaaatatttgggttatattcactacttgaaattttatattttaaaattctttaagggaagaactatgatgtacatctcaaagtgtcaaacttgggggaaacttgaggcagacattgatgtcaccctactaagagagctagttagtaattgctaatgactgaagatcatattggaatttttaagtatttattgcaggttttaggtaagttctttttcccccaaaataaaagttctaatttttaattctaaaaaagtatacatttagttttgcttgaatttgtttcattgatagtatttataaagagcaaggttaaattcctttgaaatctcacagcccagagataatcactattaataacttaggaaatattatatttccatacagtcctgtttatctttctctttttctttctctttgtctttctctttccagactgaaaggagaagttacttgctgttttgtattctattcttttcacttaacattgtaatagtcatttaccatgttaataaatatagatctacattatcttttgacaacaacgttgcacttcagtatatgcataatttattgactcaatcacttattgatggacagttgggaatttggaactttcttcttactaaacaatgccacaataactgtctttatatgcacatgcatatgtacacatgtttgtacacttacatgattatttccttaggatcaattaattatagtggaactgcaaaagtaaaatgcattactaaactgtcctctagcattggttaatatcttcaccaacaaaaaaagagactgcccatttctctgcatcctcactaattctgtaattttcagtgataatttttgccatatacatgaatattttcatactggaggtatgagatgcattttccaggcataaaaccaaagcctgaaaactttttaaaaaatacatgtattttaaattttattacatgaaaataaaaattactatggtagaaaatcattttttaaactaggaaaaatatttgtgatatatccctaatattttaagaatagctataaatcaatgatgaaaggatgaataacacaataaaaaaattggaaaagacaaatgagccgtctaacaggtttgtttgcttagtctcattctttactgcaaaggcagtgctccctgaagtcctccaaggccacctcaagctctgcttcttatgctctgatggcaacacctaccctcaccgcccttcaggggagtgttgtgggaagcaaagcaccaccagagacctatgacatttctgggttgggaggtggtaagtattcacctggttacatacatttatgtttatttggcatcaccagccctcaaagggccaggctcactcacatgaatgtaaaaattatcatcagcgctctgccttagactccagaatcagtaaattattgggaagggaaaaatacacactggcaacattgcctgatccatgtctccagggcaggattgacattattcttctcccagatgtagatagagatttctggatgttctcataaataaagtgctagaggccatgtcatcaacgtcctccatctttccccgctctctgattcccatgtgtattactacatacttaatgaaatggaatattcttcagcaacttcagggaaagtgaaagacgctagagaattggaaataccacactaacagcatcacctccgcctctgccgtgcaaactgtgatgacagggcgtcttccctgtgttctgggacagggagcatctgggttctgggagtgagttcctcgagtcttcccgagggtcaggagttgtacaaagctgttctgggtggtaattggagcattccttgaccacagaagttcatttgcagatggtaagggatgacatgctctggggcatttttccccctctttggcagaaaattgtggacatgaaagtcatgtgtgttttaaatccttagacagtgtccagaaaggaagcaaaagagaggcaaacatgttagagtctaggaagtcccttcaggccaactacaagctaaggagaatggaaggaaccaggcctaggaaatggcttatcctctacctgaacagtcaaacacctcttgaggtgtgcacatatggttatgagccaggctttagtgctgccagcagtgcccttggagaccatgccactgactcagtgtacctagggctcagagtgtcaaatgtctcattttcttaatgatgctcctagaaagcttcacatattatccacatgcttctgtaacatagtttatactcagaagctggggttcgagggagattttaaatgttatatatacatatatatatcttccacatacacgcatcctacttgtttaaggagtcatgctactaggacacttgcagaggcatcttgtacaagaagtctttgcagtgataaaattaagagttttttttcttttatcagggttcttcttttacatggtctctttgtgtagtctctatattattcttcatttcttctaatgtgtgggtattgagaacagatcaggcatgctccagagaatcatttcaagatattcatctaaacaggtcaccttacctctcacacttcgataggctaaaatgggttctacctttaatccctggtaaatttctaggctttttgatacatgaagaataattctcacctctaatttaaaattaaccttgtactttgaatgagagaaccgtgtgtctcatgaaagaacatgagtgaaaggtacacctaaatcttttaatagtagccttcagcctagtccttataagctactcaaggacacataagaaaagtaatgaaaagtcttcagtcaaaataattttctgagttttttttctatgcttttatccatcaccaccatgcttgaataatcttcactgcattggttcttcaccagtagctttcacatactcctctaccagttttataacagtacctttcagtaaaggttaggaagaatcctaacactgttaacttcctcagtaagcatgcactatctgttgacagggtgtctgtagactatctatttacttaaaaagaaccaattttttcatcattacattatcatcagtcattaacattactcatctagaatgggtacagaggcaagccacctcctagtaacctatgtgtttaccactccatcccaaatctctgatacacttagaaaaaaagttttagacatgtaggataacattctagaaaacagtttcaaagatctgaatcttagcacaggaattcatacaccgccccccccccccacacacacacacacacactcttactgaccaccattatttggaatttttttttatttaatcgacaaagaactacagctaaaacactttgaagtattccttttgaaacattttgatgttggattctggcttattccttcttagaaaatgagggattacatttaaatgtcaaataaatgcttgtacctaatgtgttagtccatttttgctgctataacaaaatacctgagactgggtaatttataaacaacagaaacttatttttcatagttacagagactaggaaattcaagattgaggcacctgcaaatttggtatctggtgaagtcctctctgcttccaagatcgcacctcttgctgtatcttcatatggcaaagggtggaagaggaaaagggagagagacagctccttcacaccttttatataagggcacaaatccattcatgagggctctgccttcatgatttaatcacttcctaaagactccacctcttaatactatcacatgggcaattaagtttcaacatgtgaattggggggtggtgaacattcagagcatataatctaataagaaatgaatccataatttttgaccgttgtaataaaatgatatttcattaagcatcactcatctctactcaagtagtgaccaaaagatggagatgttcttcagagaggagacaacagctctctgtgggtaacccccaatatggatgcagatttggaaacaggaaagcatgcaagtaaaagcaccagaaaaacaaccaagagatgtctgcaccttaactgcactagccaccctaaaatgagttaggctttataagatggaataaaaaacatgcactctagacagtaatccacttctaggattgtgtagggttttagtttcctctcatttcttcgcaaaagtatttttgtaaaaataacttggtctaagaaaaaaagatttctccataccacagttggattatttcatgggaacagtataccactttggcagactgcattgactttcagaccagcatgcggatccagggaaaatagactgagtgacccaggaggggcagagtcaggactggctgtatgcaggagtccttaccatcttccaaaagctaccaaatcaatcctttatttcctgtctcaacaatcggcattggcaaatttaaaagatcaaagttccttttaagacctgagctattatattattatatggggattacttctagatcagctactgttacctttgtctgtggtccagggcctcaaagcacttccatacacgtgcgtgcgtgcactcacgcacacacacacatgcacgcgcacacacacacacacacacactctattgatatgagcttttctcctgcctattagatgcattacaaatctgcctataatggggcctctctgcattccaacaaaaatatttctggagctctcctggctcccacaacatttgctgggtgcacatttaatatgttttagctttactgcctgaagatggaatcagggacatctacctgcacatgacagtgctttggctcttgcagttgcagaacttaatgtatgtatcagtaatgaaaatcttaattaagaaagctgcatcattgtccatgaacactcatttttctccccctgcaaagccctttgtgtattgcagtatatacctggtccagacagacagagccctcgaagagcttgtctggcagatcttctcttgattattaacagctagcgaatgacaaagtctcgctctccttttgtcttgaagctgaggcttggaacagcagagcacacaatgtactgtagggtttgtttgtgtttttttaaacttgcttttattacgttggtgggtttaaaaatccgacagtgttgatcaaaactaatttaggtaacttagagttgccaaaacactagcagatgcatatttacacatatactctcagaaaaatgtaattttccatatagaaacaatgcacaaacataagaagggaaaattttaatctgtctgcccatgtttctggtaactttggcctccagtacttaaaggctgcaacgtcctcacatatgtgaccttagcagttacttcttttcctgtgccattgtgcatgtgccaatttgtcatttgtgcaaagagtaagcagctttggaaaatggaatgactttatgcagacaactaactgtacccataaaaattacaagagttactaagaaggtcctttgaaccttagttcaaaggaccttcttagtactactcttgcaatttttgaaaaggtggcctataattatgtttatgaaacaatgccgaattgtgatattttaataaagctcacatcataattcccccaaataaaaagttaatcaacttaaaattctcttaaaagcctcaaagcatttcactcttcgaaagtagcaactcctaccaattaagtctatgacctcgacccatgtcctacatgatgaggagagagactcatgttctcagtcacttacatatcgttcagtcttctgcattttctaaatttctggtctacagtgttaaccatttactggtagagccatgtaaataattgaattggattcaggccgtatgcttatatgatactttctactggaataggacatattcacttaaagaaggtctgatagtaaatacttatgatctgtcttctgcttgctgtacctatactgccctcaccaagaggggagcagccatgctgtctcagatggtaatggtgtgctgcttatttactctccttataagttcgcatgctttcactcatttattttcaaaatcactgtaaataatggtcagttttctgcatatttgaagcaacaaaatatttgtacaaatattctttttgtgtatcatgaaagatatgaggaagacatcattatgggaaaattattttcaaatagtctaatttattaaaatctcatgattgcactcatagcatgtttaattaaagttaaatatgaaaagtaaaaatagacttatgttattaaactagaaccacaatgagaaagtaaaagagatgctgtcaaggctcttcactgctacataggaattattgtgaacaggttgttgcactctgaaaacttttcctttttaagaactatctgaccagtactgctataaatcctaaagcagctgtgaagtaataggcctatatttgtgctgcaggtctatagtataaagcatacagtaagctctcaataaatgtttggagaatgaataaataattatgagtgaataaggcaaagaatgaatagcactggcatttcaaagactaaatcagaaaatcaggtactgttcttaatttttaaaagtccttgattagaggttagaggtctgctgaatttctagaccttggtctataactttccaaacaataaactacttaaagaattatgaataatcttaatatttaaaatttgagcagattggttactttctacctccagaacacacacatacatccatgtatgtgtgtaaacagttactgggtcacaatataaaatgtagtttctactataagtcatgaataaaaatattttaaaccctgccaaaaaaacaacaaaaaatttgtgtagattaagataatatcttctcctattcagaaaatctacagtttgcttaaaatttaagagtgactgacccattaaaaatcacaggccttctttccttatctatgaggtaactcagatttggcctccattctgctaggtggtctcctctccccttccttggagtgccatccaaatgcaatatgaaagtgagggtggagagcagttagatacagtctactcactatggtgtctggtcttctcagtgttgtcttctgagctcaaattccctgagatgtctgagagcccacctcatctttagtttcctgtccatgtagatccctgatgtgtcttccttgtcccagctccaaggcctcctcaagtcttcaggctcctttgtcatgtcttccttgctctgggcccttctgggtcatgctggggcatggtgaccctgtgaggttatcttaagtccatagtcctagacacccccctgcaaagacatcttcctgctcccacattgtggatgtgtttaccctcagacccaaccctcaccctacccttgctctacaacagtggctgacccatgtcagctagattccaagttggatttggtgcttgtgagacacttgtgagtggcaagagggtcagtagaaggcataggccagagatttcccccaccgttctttgcatcatcatcatcaccagccacatttcctttgtggtttactccctctgaacaaacctgctgtgactccagcttccctggtgacccaggcctctgggcatcaatagcaccatctcttcccattgtcctttcagcatagggacatagagacacagtccttcacctaaaagagtccactgactattagggaaggatggatgtgtaacacagatgtctgtaatgcagcaagaaacagagaggaaacagattatttaaaggatgcattgggactggagatgcgcatagagtcgttccaatacttgcctgcaaaatagagtttctcagagaaggcctaacagtcaggtggtatttgatctggatcttcaggaatgaatacggatttagcaagcaaatcggggagggattctcacctctgttatttctctgtgtctctcccaatgcaatgattttcaagagaagcttgtacactccttatgtagaaacataacggatctctcagggtttatcctcgtttggattagtaaatggggcagcactagagtagtaggatgcgtgtgacctgagtttcaactctgttgagtagcatcagcagcttacaggaaatgaggttttttttttttttaatgtatccttttgtagattcgatggggccatttctagagttcagtcttgacctaaagacttggatctcaaggcactcaaaccgtcttacagaatgtgcaatccacaaaaaatatatacttaagccatttaaaatatattatctctatattggccaaacttctataatgaaacagatttcagactatcctgtaacactccaatctgtcagaactttcctcagaatactgtattttgctatttttttaaaacagagaaataagactattgatttacaactaacttcatctattagtatgctagaaacaatattcctaaacttgtcctttatgatctaataattttaaaaatgaaactaattgttgttctttccattgtttgaaaaatggaaaatgataatattacagaaaacagtaaagacattgaactgtttaaaaaaaaaaaaatgaccagccttccgatgacttaccatcctctttgcctctttgctgacatccctatgtgttcctcatcatttttgtgcttgaaatatgtattgtgtcagctttagtccagccaacaagttgagtaatccagcaggtttaggacaaagaagtgtgttgcaactgaggtaaaaggtctttaaaaagcatattagctgactatatggatgttcttcagttcaaacctgaccaccctttgctctcacatggaaatacatccacaagcagtgttgtaagtgatcctatcagcaaacgtgtgcatcagtgctcctccagaacatcatatttacgttagggcttaataggacattcataaagcaacatgcagtttgttatttttaaatgcatgtgacctccttatttcaaaagcaagtatctttaaacatagtaatagcatttctctatatgcaaacctctgtacatgaaaaggtttacattttaaaacaaacatgtttttgagttttatccaaattcaaaaaaagcatctgaaaaatttaacagctgaaaaacactttctccttgctgggaaaacttaaaccttgctaggctttatgcaacttaaaaaaaaaaaatcacttctgtgctgagaactagcatgagaaatctcagcatgaaaggttggtggattttttttcttcataaaactaagcccaattgttggttttaagagtgatgccacaatatacatatgctttgttaggaacaaatataatctaatttcaagggcatcttcaacaaaaattagggggaaaagataaaggctacttaagcagtgatccagtgtctgaaagcaaaggttgagaacatcattgtaccatcaaggtctagaaatgctgctaaccctgagcgggttgttactgtttgaaaagcctatgggtatttgttttattgttgtctcactcaattcttacttagctgagagtatctcacaagggaagtactgctctgtgatggtgtcctggactttgttttctatttgtttcagcacttcaataaatggtctgttacctgccattatgacctgtatgcatttgctgagcagtttttcaaaacaaaacaaattatgtggctgtatttctagaacgctgagccattttcaagatagtatagaattagaaacacacatagacacgtccacacaattgtatgtttatactgaacacatatattcagacatattcaggaaaataagaaaaaagaaaataggttggacaatacaaatatggaaatacagcttgttcaatcatttagagcccatacttctaacggtgtacatatgtagacgtgactttgtaaagaagacccacatgtgtgtctacactcaagcatcttcctcttaatactctactgaggataaaggacacaaagtaatttttgaaatatcatgctggctacttttagagtatattagtgtgagtagtgacttaagaggtcaggtttaagagaagtagcaacatacttctattatttacatggtgatttttttttataagtccttccttgaaggcagacttagatatttcaagacctccttagaaaaatttttcagcaccttctgtgctccaaattgagtcagtttgcatcatgtttcagtgtaactgagtaacaggctagcaaattctctgctttcttattcaccaaaatccaaaatagaactcacaaaaactccttccttcttccccccatcctgaaaaaacaccctactgtggcccccccccaatagaggaacagaccagaaaaaaaaagagtaaacagagccagctgtaactatagcactttgctcagtactgtgagcttgctagagctggcacattttttataatacagatgcataaatgtactgtctgaggcagaggaattgcagcatcccctttagtatttcttgactgccttggtctaaagtatgttgcacaggagaagcctccctaaacccagaataaaatacttaatttggtatctattttttaaaattgtgaccttctatgacttaatttttcataaggtttgtagaaaaccacctttttcagactttcacagggtttttccaaattcagacttccggggtctatgtcttactctcacacatacacatatgcatacacatttcagattacatatttaaagtaaaatatgtaaatatggactgttttaaagttattaaatgtgtatatgtgtttgtgtgtttgataatgaattgtttaataatgaactgttgtttcacagtggacataagataatcaaaccaatggaaaattattgtttaaaaccatgatagctattagtttttccagaatgagatatgcatttttaagagcagcttgttatggagtactactttttcttctctaaaattgtttgctagaataaaatttgttaaataaataattctgattaaagtgaatgggaaggagaaaggtactttacccaaaggtccagttaaacatccaaaattggaccaaaactttgtccaaaattcatatctgcctctgaggaataaagattagaaacactgaagtctaggctgggtgtggtggctcacgcctgtaatcccagcactttgggaggccgaggcaggcggatcacctgaggtcaggagttcgagaccagcctgaccaacatggagaaactctgtctctactaagaatacaaaattagccagccgtggtggcgcatgcctgtaatcccagctactcaggagaactcatgaacccaggaggcaggggttgcggtgagccaagatcgcgccattgcactgcagcctgggcaacaagaatgaaactctgcctcaaaaaaaagaaagaaagagagagagagagagagagggagggtgggagggagagagagagagagagagacagagaaagaaagaaagaaggaaagaagaaagaaagaaagaaagaaaaaaggaaggaaggaagaagagagagagaaaagaaaaaagaaaagaaagaaagaaagactgaagtctatgcaaaagagtgcagggtacggaccgggcgcggtggctcatgcctgtaatgccagcactttggaaggctgaggcaggcggatcacctgaggtcaggagttcaagcccagcatgaccaacatggaaaaaccccgtctctactaaaaatacaaaattagccaggcgtggtgttgggcgcctgtaatcccagatactcgggaggctgaggcaggagaatcgcttgaaccgaggaggcagaggttgcggtgagctgagatcgtgccattgaactccagcctgggcaacaagagcgaaactccatctcaaaaaaaaaaaaaaaaaaaaaaagtgcagggaacaaaggtcattttcagtagcttagagatgaattccagaggttcaatcctgtgtttgaaaacagaccctgtgtccttttgggcacattaattcacctttaagcatcagtttctttatctataaagtaatcagaaaactcttatgatgattaaatgagatagtacacatcaaacatgtagcccagtaaggccaatatcaaccacatagaaaatgcttcgtaatggtaattatggatctaaattattttagcagtggtcgtatctttgaaataagcatttagcctggagatagaaatggtgcacacttaagcatgttatttcaggtatgtttttcagtttatatgtgatgtttctttataagcacaacgcataattatgcaaccagtattttgctttttcaaaggtgacatttattgcacactaacagtgttctaggtactgtggaagggattagaagcacatcttctcttatgatccttagaacagcccctataagttaccattatacccatttttcaaatgagaaaactgaagctgagaaagcatcagcagcttgcccaaggttagataactaggtaatgatggggtaagactttgatccaggcagtctagccctaaactgcaacctaagaaaataattacaagtaaacaaaagccattatgcacaagatatttatcatatggctgtggcttgactgtgtctccaaaagttcttgtgttggacacttaatctctgatgcaacagtgttggaaggtggggcctaataagaggtgattcagtcatgagggctctgccttcatgaatgaatgaatgccaccactgcaggagtgtgtgcattagttatcatgagagtgggttcattatagaagtgagtttggctccttcttgctctctggcttttgtgctctcttgccctctgccttccaccatgggatgatctagcaagaaggccctcaccagatgccagtaccttcatactagacatcccaacctccagaactgtgagaaatatattttttctttttaaattagccagtttataatattctgttacagcaacacaaatgaattaagacataaatatgcttttttacctttttgttctagatatttcaaacatatacaaaagtaggaagaatatcatagtgaactctcatgagttcctcactctgcttcaacagttgtcagcccatggtaaatcttgttagacatatttgtattataaaactggaaataagctagatgttcaactctagagtgctgtgttaagtatagtacgacatatctattagatagaattttgagccagtaaatgtttatgaagaacctataatagtatgaactatttatactatatattaagttaaaaggcagcatacatagtaatacatatggtataatcccaccttttttaggatttttaagattttttattactctcctatattttctaaattgtatatcatgaacatatcttaattgggaaaaattaatatttctctaatattcagaaaaatatgaatttcttcattaataaaggcagcttatttacctagcctcacagagtaagactccatctcaaaaaaaagaatatacttaccataattcaaacttttctaaatgattcagggttgttatcttgaactacaattcaaatttgtttctattgatgagggtgtggaagtataaaaataatgctacatatttgaatgttattttatggtttccaagcttctcaattaaccatttggtccttattctataagattatttgcttctgtgtttctttaccctctgactgctatatctttagttctcatgccttcttttcgtagtttttatttttcttctttagctattaagttactttctgttgtgcaagtctctaagatcctcattccttctctgatgcattatttctaatcttctttagacaataaaacaaaaaaacatgttttgattgtgtgtaaagtacatacatgaactcattcacttgacaaatattgtgagtcgtgcacttgtatacttggcactggagaggatacacagataagacatgtcttgccctagaagttttaatctagcaacggagctgagacatgtgtctactttgctagaattaatagtgaaaagtgaaatgctctataaaagtagtacagataaggtattcttggagctcagaggagggctaactgagggcttcatcagaaaagatgacactggatttgggctttgaaaaacaagcaggatttgagcatacagagatagaaggaaagaacattactctatcatgagaaaagcatggaagaatcaaagggtaaagattctgcaaagaagtaattgagtttaacttgagcatggaatgtgtgaagataagtagtgggaaataaagcggtaaaagtatattgggaccagaaagtgaaaggacttgattattagggcaaggaatttggactttattcaggagacagtggggagctattgaaagtttttagtaggagagtaacataatcagagctgtgcctcaggaagattaatctggcaacagtgagtaaaatggattggagtagggagagaccagaggacacaagatcaggcaggagactattacaatagtccaggtgaaaggcaatgaaggcactaactagggcaggggcagagggaatgaacagagatggcaaactgatttatgaaatgtggcgggagaattaatccattatatttggggagcaagggagaggaagacaccaaacacatctctatgattttgaaccttagtagagtcataaacagagcagcaaagcaggagaagggttgggaggggaaagcacacgtttaattttgaacacactgagtgaaggtgccgactgggtatctgtgagtggtccactaggcttttggagacacgacactatagtgcagcagaagggccgggcttggagataaagattttgagtcacctatgcctcactagatagagaagcaagagaagaggcttttaaaaagacttggaggattatgtgtggtttatttagtaccaattttggctgcttgcaggtctttttcactttgtttgttcttaaccatatttggaatgccacataagtggtgtgcagatatgtgaagcattgctgtatgcatgcaaacacacaaaatagattctaaaataatgaactagtttgggatatagctaatggggtcaattttacagtgtccatagactatcttcacttgtaacatattcctgtgggatatggtttggctgtacccccacccaaacctcctcttgaattgtatctcccacaattcccacatgtgggagagacccagagggaggtaattgaatcagggggcttgtctttcctgtgctattctcatgatagtgaataagtctcaagagatctgatggttttgaaaaggggagtttccctgcataagctctctcttctctgccaccatgtaagatgtgacttgctcctccttgccttctgccatgattgtgaggcctctccagccacatggaactgtgagtccattaaacctctttttcttcccaatcttgggtatgtatttatcagcagtgtgcaaatggactcatacactgtgtaaccttagagaaatcactgtacctcttacttctctgggtctcagattcctcatcagatagatgaagagattgatcaagatccctggtctccataactggttgcaagcagccaaaactgacatagaattagaatcacttggggaaggcaggggaaggaaaaggcccaggaatctgtgatttgtattttctacttactttttattttttagagacaggggtctcaccatgttgccccaggctggcctcaaactctgggggtccagtgatcctcctgcctcagccttcccagtcaccaggactacagccacattccactgtgcctggctgggaatctgaaacctctctatgtgattctgagacacatcctgggttggaaattgccgggctacaaaacctcttaggttcactccagctcttatattctaaagctttatcaatatttagacaaaatatgcatttttcatgactcactcataaggaaggaaatatatcaaaaatgcaaacttactttcaaattcagttcatcagctaaatactccacctctctcctttatattaggaggacaatatatttttaaagtatttgaaagacacaataatttggaaatctcctgtgattttataaaatgtgaaagatatgtagtgtgtgccgaaggggtaggacggaagggaagaaagccaggaagtctgggacatagcacacataaagcgtgctgttcaccagccatacctggggactgtctgcatagccacagttgaagtatgtctgtgctctgcaattgatttcagtgctctggctattcttgttgaggcacgcagtccttgtactgtttctgattgtacctgtcaggttgtatatataagcatttcagaagtccttctgtgcagactcagcacaggtttagcgtgaaataaaagagccagttgagattccagtccaacaggtgagctatttccttaatgggcttatctttaacataccctctttggtttggtttccatcatacatttcatactttacctttcacatagctcttgttattacagcattgcctcagctttcctagatcatacattctgaagcttccccagggtcaacagcatgctgtattgggccacacagaagggaaggagagcagtgaggtatcttttttttttttcttctgagatggagtttcgctcttgttgtccaggctggagtgcaatggcacaatctcggctcactgcaacctccacctcccaggttcaagcaattctcctgcctcagcctccgaagcagctaggattacaggcctgcaccaccacgcccggctaagttttatatttagtaaagacggggtttcaccaagttggtcaggctgatcttgaacacctgacctcaggtgatgtgcccgccttggcctcccaaagtgctgagattaaaggcatgagccactgcgcgcccagctgaggtatcaattctttattcacttcctatgtcctctttcttcctttttcccagggaggacccagttagatgaacttgataggttagactggattaacctagactgtaaaaacaggttggaatttggaaaatctgaaagtttccaacttccaggcaaaattttgacgtcccattttgctcaacaagtatgttttgaggagttactctaagtagggaattctgctcagcttgtaaatcagaaattagcaaccaattttagtgattttgtctgtacactggctactacaaaaattctagacataagtgcagagtagaactagtgataatgatgatgttagtactttacatttatttagccctgaactgtcttttcataaaattatctttggtgccctcctattcgcctaaggaaatcctttttatccttgcttgtgtcactatcatccccttctcccacccttcagttccacagttatccatttcctttccccattcaaactgcagcttcttgactttagttacattcagttaggtgatctggtaaccttattaaagtaatttactccaaggtgtaaatgaggtttaaccctcttggagaaataaatattttaaaaatatcttgttagacaactgagtttctttcccctgttcagttaatgacacatgaagcgagatgtttttttgagtagagtcctcagttatatctcctttgccctctgacctccaacacacaatgttttatttacatttgtaaaggaaaaacatgaaatcagccaagcagtcctatatctgtcaccctctacatattctctcagtcgctccacctccctgatgtagctgtactttcaatgtgacatgacacccccatatatcagacatttgctgacttcaaccatgcaaccctgctggacccaccaccttgtttcctcatctgttcccactccaattcctgattcctggctgcatcttgtatttatcatcttaatattgatctttgaatttacctctttagattttgttcccatattctgggagagagtttagcaaagtacaaaaagcaaagctctggagtaaaatgccactagtcatgtgaccttgaactagttatttaccatctctaagcctctgttttctcacacgcaaaatgggagtagtgtaaaaattaaatatgatatatagataggatgaagaatattaagagttcaatgcatggagttattattgttaatattatttattatctttactcccctcaacaacttcaattgggattctcccctgattctaccttggagaacctttcttgagtgttgtatgctggtcaggactagtttcctggatgtgaccttttcagcattttatacacaaaataatgtcagacactacatattttctgaacaaagacttaggacataattttataaatacatgcatatttatggggataataaaagacaagatttgaaaccaggtctgctccaggagatcagagacttaatctcctatatctaaccttaggatgtgaattctatacactggacaaagatgaattttagagtcgtaaggtaatactgataattaagaatatgatagctctgataaccaattgtattaagaaaggatggtcaattacacaaagaaaagatgttagtatttcaggaaggagtttttttcttctaaaggagaaagcagagccgttggagtcatatctgggtttgcatgcaaattctaccacttaaaatccatggacaaaaagacactaactaaatcaccttggtaaaagcattaaatttatttgagtttcaatttccttatcagtaacagattaatgacacccaacttgtagacttattatgaagattagaaataatgcataaaattctggtatattgttaggtctaaataaatatatttcctggaaattgagagccaggtttctcttcaagatgaaaaaggagctgaaattatgcctgtcttccacatataaccaagatctatatttaaaagcaaataaaaaactaactactataaaacatggaaataaacattttccacatttacatttttaaccctaatttttccactaagtatattcagataggcaggttaaatataaattaagtactttttcaacatcagtttctaaaacagaaactttcaaaggattcctaatgtactttagtagtataaaagtgtcttttgttattatataagggaaacatagggtaatctgagactgtgtcatttttaaaaagctgttaagaaatgatcacctaacattttatggagagataccagaggtatttagtgaaatctcactaaaaagagactccctttttctatatctttaatgcttaatttccaagtggaaatattgtttttaatctaaatcttgagcattttagataagttgagaaattgtgtggtgagtggtttttgttttttatttctaatgaatcagtaattttgaccttcgttccatatgcctctttaatttatggtgaataagtaatactgatttttcaaaaattaatgcacaatctcaagcccccaagttttaaaattatgatatttccaatggcaaatgaaataacatgctgtccatgcagttagtgatttgaggcaatttgaacatcatgataagagagggagggaattacaagcagtgttataattaaaggtctgttgattcttcagtttaaatgccattgttgaaagatttttcactcagatgtcaaagtctgtggccagccaaaacttggcatgctagaactcagcccagggaaacattgtgttctacagatttaaaaaccaaaatctgttaagaacagaaatgttgggcttgggctgatttctcatgaatcagaaccagaacatagccaaataccacctcctctttatgaaaggaagtagtgcaggtggatgttaatgggaaatgtttgttcagatgggaaatgaagggaaattatcattagatatcatcatacagtgcactgggttagagttttatatcattaaagcatgtttctttgtgaaattaaaagcattttagacccctcttctattaaattcttcatgggtgttaagtggggagcagtatttacccatctttcaagatttgcacattgaggttcagtctctccacattacattccttgtgactaggaaaacttgaagtaaaactttatttgcttaactctctacctagaaatatatttccaaacaccgtcttgccctttctttaattagaaagttacaaatcagtggcctatgagctgcatctagctagcagatagaattttttaaaatgtatgtttggtccacagaatatttaaaataatttgagccaacctttaaggttaaagagatttcacaccaaaaaaaaactagatttttttttttttttttttttttttgcttctcttgaaaaattggagatctgacaacattagatctgcatccacatgtggcaccaatatctggaactgagtagcagctgctcacttcagacaaaccatgttctctccagtttgacaaagtccctatcaccccatattttatgccacacctacttcactcatttgctcttccaccctggctccttgaggcatttgacttttctttcattgcttgtggtcgttgtattaagtttcctcgcttgtggtattacctgttaaagtttccaaaattttcttttcattaaataatagcattgcaaagactatgcccaatgatactggacaaagaattattgaaaagaataaaagtcagaatgcaaccaaaatgtccaaaaataggtgattgtttaaattgtattttatgctggtatatccttagaatagaataccatgtaggattaaaaatgtttatcttgaaagaatgaatgcagattactaaactatgtatacatcaagattcctatgttgtaggagaagaatattcatacatatagaaaaagagctaaagtgatgtgtcaaagcagtatcagaaaaatatgtacatatacaaaaaatataaacaaataagtgaataagtaagtcccaagggcagcttttgtgggtccccttctacagggctttgttagtcccttttgacctaatggtttgaacatatgctaaagctattttttaattctctatcaaaacctgattttccttcttacctttattctttagagaatacaatgaagaataagatttctgtagttgttttaaatacttgagaaaagtattcttacttgcccacatgctacactgccactttggcaaagcaagagaaccagtttctgtgttggctttgagttagtttgttcttctaaagcaccttttggtgacataaaaaaatattcaaaactttaaaaaaaatcttggaacagaaaaaatacacataaacattgcacttaataacatgaccacaaaaactcttagaggctaggactgaaactcatcatcacaaaggcgtcagctttttgccaaccataggaaggagtgctcccaggtaaaagccatccaagcatttatggaaatttttctgatcccagcgtttagcacaataccttggagttaggaaatgctcaaaaatacttcctgaataaaatacaaataaattcacattcccaccaaggaataattaacctgcatataaaaattcagttatcttttgaattaaaatcaaaccataaagtttggatcttgctaactactctaaaaacttccagatatagttttgcttcagagttaataatgccaacatttttcctaggaaaaaataatgtttgtttatgtgtgtgattgtatgcatgcttgagtttagggaaagggtagaaagcaataagaggtggtcctttcaaagatgagtacagtgatgaagactctagctcttaaatatacctcttcctcacagcaatcctaggtatcctgtttatgatttgattgttttgactatctatctctaattcttgaagcatttgaagcattcttcacctttacactctatagcgtctgtttttatggttctcctgttcatctgaatgatctttcatccatcctccctttatctgcccacaaaatgtaagtttgtctgtctttctctcctcactgcattcttgaaatctgtggacagtttcatgaaatccacatagcttcaactagatgtttggagcacttccctagagatctaagtatctagtcctggcctgtagactctggtactgcacatgtgggtttcctgctgctcaatggacatttccacatgtttcacccacaacatctcaaactcctactgctatcctttgagtagtctagaagctagtcaaattgaccccagacacagtttgtgctttcctatcccttgctttgactctttctgtttcccttgcctaaaacctatctctccaatttctaattgttggaattttcccacattccaaagtccatctcaaacactgcctgcttcaggtaactttgtcagtgtccaccgctgaatagcaaatgatattcctcaagtcactgaaacctacagattttttttagcaacgctttacggtattaacttatttgcatcgtgttttagttatgtggtatttcttttctcccatgttctaaatattaggattattgcttctaatctttgtagctactttctagagcttaggtcctagcagagtcccttgctcacagcaggtgcttattaaatatatactgaattaaattggatttatgtattgatggttgcgcattgcacatgtgttgtgatttgggagacccaaaacatccacctgcccaaactatctcttccattttccaggccatagtatcttgctttgggacgttctcttgtacaaatgtgaggaatttccacaaatttagtcttttgttcccaagctaagtacactattggctgggtaacatgtgagttctgctacttgttatctcctaagagggagcaaagtcttaaaaaagaataggccaaagttcagatatgttctcatggaggcaacagataggaaaaggtccatgaaaaagacaggatcacagataggaacttggactgtgccacttattagttgtgtgccttgcttgtctcatctgtaaaactagatgataataataatgatgcctaccttagatgttatgagaacaaagtaacggggtgtgaagtgcttacaataatattaggcacattgtgttagtgagggttgactattattagttacatatgtcatacatatatgggatatatatagtgtatatgtactcatatattaagtatactctttctcccctcactgcattcttgaaatctacatagctgcaactagatatttggatcacttccctagagatctaagtatctagtcctggcctgtagactctggtactccagatgtgagtttcctgcatatatatatatatgcttaaaacataatgcacacacacaaatgtacatacatgtatttgttaattattgtcgcaaaggaaatcctggatactcagagaccttaaatgtctgaagattgaggatgtataagagaagagatgagactctgtcacacagacctgaggtaaagctcagctctgccacagggaatacctgtcttttatatttgttttaaagattaaatggccgtgtcatgagcataatcatcctaacattggactttggacctccttcttttggtgattcctatccctttcttttctttctttcttttttttttttaagacagaatctcactctgtcactcaggctggagtgcaatggtgcgatctcggctcactgcaacctccggctcctgggttcaagcgattctcctgcctcagactcctgagtagctgggattacaggcgtgtgccaccatgcctggctaatttttgtatttttagtagaaacggggtttcatcatattggccaggctggtcttgaattcctgacctcaggtgatccacccgcctcggcctcccaaagtgctgggattacaggcatgagccaccgcacctggcccctatcctttttctgaactacacatttgttttcttgacaaattagatttcagacttttgttctggaccaaacttagaagaaacaggtggtactgtttcagaaaaatggtgtcagtacaagctaatgatttcaaattattaataatttaatacagtagtgaaatgttaaaatatgtacgaattaatatgcaccaagcctaacagagaacaaacactcaccaaactgtagctaaatccttaatctagaacaaacttaccagtcagaccaggttttataaaaaataaaatatctcttacctatggaaataattaattatattacagattttacaactggcttttttttttttaagtacaagaatttaggtttttacctaaaaacaaaacagtcctttccacttagttctatttgaagggagtgtgtgggggttgggggagaaggaaaaacgaaggggaaaaaaagtcttgagaacatctacaaactcctggatattcagagctgaaagaaaaagaaccttgtaatgtaccttcttgcatttagtcctgttattgtagtgctgtgatgtggcactcaatgctctaggggacctagagcaagtgttacaaatgcaaccaaaagtctcatgaaaatgagcctcttaacagtgtgtgagctggtctacaatggcctcaggaaatccccccagctattcatgtcctttttatccactacattctctgactcaaagggaaacctcccttcacctccttgaccagaattgagcagacattgatttggttacctagagctttatttattcatttattagtctttatcatttgtattccactagaacaaaagaatatatcttttctttgcattaatctaagtttaaagatgtgcaaatgtgtttgtgggagagtgcatatttatgtttacgtaattttatgggtagctggctttaagttaaaatattttctgtcaaaaccatagtacatagagcctccccatcaccatcactgtgcagaatgactgtacttgacacataagctgaattcctaaaattgtttcacgtaaagtgcgccttttaaaagagatcatgtttttctattcacttctataattagattgagtgtcacacaggaaaaataagtggcccaatgtatatgtttttttaaaaaaattaagaatcacaactttcacctcagtgataatgatgcatttatctatggacactttatgtgcataaattgccccccaagaaaagccaataaaaagtgaatataattaaacagcagatagtttgaaagcaaatgctacttgtaaaccactgtactgaaggcagcgggaaatttggagatgtgtaaatcaggaattgtcctcagggagcatatagtctagttaaggatgcatagcagaaaaggtagaattgtatgcacaattaaagattcaaatagcagttcaatatattcagagatattcttcgcacaattatattaatgacttatgttgaaattataccatgtagttaatttcccttccattttagaggacttactgagtaccacatactatgacaactatctaaatagcaacaatgcattatgagctcttcacatgaattcaacttaggcgaaattcaattttggttaacaaagtttgggcaattcaagcaataataatttgttttgaggtagactacatgttcctgttcttttaaatgttaatgcacagtagctttgttacagatttccttcaggaatgcttgttgaactagtggacatttctaagcagattttttatattaagcaatcaagaaaaagcctttgaagatattttcactccctcaataccagcttcggatgctatgttttcttcagtgttatagtactgaatttgttcttacttagggaatatgttcaaagttgagttggccagaatggaaacattgtaaattctgcagcagtgtctatttcatgtataaactaatcatgatcaaaatagagatcctatagggacctaaaggaaattaacatccttagttaccaccttagctgtaacctgaaaaagggattaatgtaagttcagggggaaaccttggaggcatatacaacgtagatgtctaaaaatattcaagctaccgtacccaatatgtctgtatatatctttactctcctgctaaagagtaaataataacaacatcagtaacaccaaccgaatgagattcttagtttacaaagcattttggatacatcatccattttgatcttcagaacaatttgtaagattggtaaggcacatattattcatattttacaaatgaaaaatctatgaaatgtaaaaggacagatgacttgcttaaggacacagagctcttaaaaggtgcagctgcatctcctgatgcaccagtgtgactggctcagaggaaacagcaacccaaacagaatctttgctacacaactgtcctgcaaggcacagaggggttgccaaaaggtgacgtgcagacattagtcttcagaggaaggacgagtcctcaggccaagaggcatacgtcactattatttcatgaaagaaggaaaagacatggttagctttcttatgaggtggttttctccacatatatagagctgttgagaaatactgcaaattttcattactcagagattggataaaattctgatgattttccatgaaaatcatagttgtgtctaatctggttgcatctgagttcccttcaacctactaagagtttggacttgaacctctaaaaagatctcagtcctgatcaggaccatccttcccacctaccaggatatacatattttctattgaaaaaatatgtgaccataatcaattgttgagcgagctccctggagcttcttacttatttgagaatatggtatggaaatgcaagagatcatgggccactttactaaaactgagtgtcattggaaattgataaaaaattgtggttctgaatcccacaagccatagactttcactggcatacagaattcaaagctgtcactaaattctgctacctgataaatagaaaggtagactttcaaatcaagaaatttagcacttggttctagagactaataatgccagcagatcctccattcagcatcacaccctttaaacatctacagacttccagcctttattttggcctggagaattggacatctggagcttcttgaactttttttcagtattactacctgggagccctagttaatatgaaatatcaaggcaatatcaccaacaatgtggtcctaggatacttgcaatccaaattgatgtttcttctacaataataaccctgaggttgtaaagtgttttcatatgcatgatcttgttaacttctacattaacttttcacataaagcaatttattattattattaattattattatttccatcttacagatgagacaaatagactaagaacataatctaaagtcacatagctggcaaatgacagagtcaccatgacacctagattagcaggtgatctcactctgagtccaacgtgttttttcattagccttgatgagcctcacagatttgtcctatgacaattgttctcagctaggctttagaattacctaaagggcttgttaaaatatacacactcagacatccacctctgagcatctgattcagtaggtctagaataagacacaataagttacgtgtctaacaagtttctaggcaatgctgatgctgctggcccaaggactactcttttaggagcactatcctatagaatgtaagcggtaactgaatggcaatgatacactatggcaaaagagtcttattaaagtttggataggggctgggcgcagtggctcacacctgtaatccagcactttaggaggcccaagtgggaggaccatttgaggccaggagtttgagaccagcctgagcaacatagcaaaacctcatcactacaaaaatttaaaaattagcctggcatggtggcacacacctgtggtcacacccagctactctggatgctgaggctggaggattccttgagctcaggtggttgaggttgcagtgagctgtgatcacaccaccagtgcactccagcctcggtgacagagcaagaccctgtctcaaaaaaaaagaggggggggggaggagattgttttgtttgttttttgcctaagctgcctcatgcttcttttttctgacctctgttaagaaagctcagaaaaaaatgtggggtgggggtctagcaagagagcactcacttctgaatgagttcaggtctctggcactcaagaaatggacactgaaacccttctctttgcttctaactagaactactgttgtagattaacttggagatacaattgccaaaccaccagtgaagagttactataagacaggaggtgggcaaatgtgattagatggatctgcagccaactgatcaattaaccaataatcattagattgattgctttatgtcaacttagaaggaagctcttagtgtcaggagaaaagaccctccttgacttatcctagtcaatatttttctgaagactggtaagggttcttgtatcacaagctcagtttgaaccagtaaggtaatatatctgctaaaataattttttaaagagctaagaaatatttcaactgtgttgaaagattatgtccagatcaaggtagctgatggtccctgtgttaatttcctatggctgttataacaaattaccacaagcttggtggtttaaaacaatgcaaatgtattctcttacagttctgaaaccagaagtctcaaatcagtttcactgtactaaagtaaaggtgttgggagggctggttccttttagcggctataaaggaggatccatttatttgccttttctatcttttggaggaccctgcactccttggtgcatgaccccttcttcaaataaccccaacctcttgtttctgtcatcacatctgctaactctgatcctcctgcctctctcttataagaacctttgtgattacagttagagtccacctagaaaatccaggataatctcctcattttaatagccttaatttaatcatatttgcaagacccctttgccacgtaaggtaacattcaaaggttctggggattaggacatggatatcttttggggggggccattcctcagcctactatagttcctttgtagtgtgtttatcagactacattaggaatattgtacccctttatcagcaccagaatttaagagttccgtcagtaaaatatgtccaaaaaagaggggatctggagtcaagagtataaaagccatctttcaaagtatgagtgagaagagtgtggaaccagggacagacagactgggttccagcactagttcacttctaccaagtttttttaccttaagcttgtcagataaaatatctctgccactcagctcttctctgtaaactgagagaaccagagaatttcctaaataccttctgcttgtataaaatctgtcaggctgttcctaaatggcatttaaaaaccaagtgcttactatctctaatattcaggataaatcttgtccacttttcttttgaattcaaaattcacctaaattttgaatttaaaacatgttttctaagtacttcttgctataaaaatagtggcgatactatgaaaataaccaaaacaagtgcttttcactagctaattcttaaatactataccctccaatattattttctgaacatcaaatcactaatcttaggataaagtatgccccttttacatgttgaaaacttgacacacagagagaaaaatttgtatttactcatgaagaacaaagggaattaaaatttgttgcttccagcttttctgggagatcatctaccaccatggcaggtgtgatgctggacaatacattaaatatacaaggtagaatggaaagaccttgtcctggaagagctcagtcttaaggaatgagtaactaaccagagggcagtcactgagagactgctatcattattacaggggtcaaacaggtgggaaagggctgttttatatatttattgtggcttgttctcagataagagcatgggacttgaccactggttctcaaaaggaaatatggactagtttgatacaaatctctctatagcatgagggttatcttatgaacaccaactttaaatgatattttacagagcgctacaaaaaataacttggaggaagtttataagaaggaaggcttcaagagctgaaccagaaaaaaaggtgcttgaaagtaaatcaaattatgagatacgttgaattatggcatttattattatgtgcagaatatgcatggaattttgaactaaaagctgaaggagcaaagatctagaaaccttcctgcataataaataaattaaccctttattctcttattttccacactccctatatttgatgacttattcatacaaatgtacactaaaaaggcctaataaactatggtctaccatgggtgcatttacctatttgtgtacatgttttaagcatatttttctgggagtgtttctttagtataatgcaggcacagtatttcaaaggccaagaattctttggaaaaaggaaaaggagttgtgtctgtttatgactgtcaaactttcctaagcttattaaattaggatatgttgtccttttctttcataatttgaagattattctagtgatatgtttggagataaaaaaaaaaaacctgtcaagtaagtcagagctaataaatgggttaataattcactgaaaacccgtacgttcagtatgctctaccactcaggacttagtctcattttctactctaaaatatcgaagttttcattggtatttttttatactggaaactacatagtgtaagaaaatcagcttatcatgagcaggtcatcagctctggaaatatctgcccatgagaaaaaaatgtgattggaattctgtcaccaaggaaatgttttaaaaatctgtttcattgccaaacaaaaagcttcaactagttatctttattttacaatgactttaattcttttgcccattcatttattacatagctactatacactgatcatttagaaaaaaaagcaccctaaatgattatgcaaaccttaaatataactatatgtttgtgtgtattcgtatgcttttttaaagagcacatttgtgacaggaagtgaagaatggcatagtcgggggaaaattaaagagacacgatgtaattatccgaactggaattaagccaattaataacccttgtgctaacactgtcctcaaagtgctgaaaatgccgtcagatatttaaatgccctgggtggtcatggtcagcactcttcccttcatccattttcagcaccatgcagggacatggctcaccctggtttctgacaaaggactacacctgaagtgagctacagaagaaggacagattctataattcgaaaacaagattctctcaagtggttttgcacagattattactgatctccaatgaaataaaaattctagtgttttttttatttgcttattcattcaacacacattgactgaatacctactgtgtgccagtttagtaccatggctgagaatgcgggctttaaaatcagattggctggatttaattcccagctcctcacttgctaggcgtgtgatcttgagcaagttacacaatctttctatacctcagttttcttttctatgaaatgcggatattggtagtacctcattcataggattcttgtgatgctaaagtatgattttaaaatgtaaagtccttagcagactgcttagggcaagccaattagtaatatgttggccatcattattattatgagccaggaaatatagtaaaatctgggaacaaagaaataatacaaccccagatgacctaacatccttgaagtttagattttaggaatttagttctaaactttataatctctactgccaatcctttctagtagagatctgtatattagatccttgctttgctatatgctttcatgtcttgaacctacatgctttgaatataacacactcagcacatccataatatacacttttgtttacacaccttcctccataataactaccgtgtaatgactagctgtgtactttatatgtttcctcatgtcatccttaagacaactctatgggaccaatatcatcaccttttacagaaaggaaaactgaggctttcagagtagctgtgacttttgcagtgttatatataaatatgtgtttgctccaaagctcttgttcttttttctcagttcaccaacagacatttactaagcactccactgctttcttctgggctctggcctatcaggtattttggggcttgccaaaggatctgccattatcaaaatcactgattccttccccctttccaaatcagtcaactgtaggccgtgtgttttaggcatggcatagcagccattgttaaagaggttggtgtgcaaataaactaaattactctggctatgacttctctcagattacttgtctttgagtgggctcccacgtgcctgacatttctttcggttttcttctttctccctaagtagcaatgttgttgctgaagcatgactgagagatagttttcggtttcatacacatcctgagtcttgttttagggcaagaaacttaatctctccagtaacatctgatggcactgttctcttcataagcacctctttcaccatttaaaaactggaccttcaattacccattgtcaaaagggaatccttagtgaacatgatcatatgtgtcccgaaaaagataccatcactttcatgggcggaaaatatagtttcccctttttagtagctcattttcaattgaaatatattggaaaggttgtacatacctaattctccaggtggaaaatctcatcagtgctttaaaactacatagtatgctgaaagactcaatctctttcacccacaatgtgcctatattttagaaacgaggtgtatgagaaaaaccacatcttctcacttggtgatatatagcagatgatgttcatagagcgaattgtaaattcagggtgaggtctttgtagatcaaaccactagccttcattagcttgaaaatgtgacacaagttatatcttgctgagacgaggcctctacaatattatatttttctgcttttctcctagaatgaattaaagacttaaatcccttgttcctagcattcaaaatggtctctctctctctctctccatatatatatatatacataaacacacatatatataaagtggaaatgtatttatatatgtaattatatttccatttggctatttaaacattttgagaaattggaggtttgtgcactaactatataggtggagtaatcttcttatttgggaggtaagggtgattttcatacctgttgggccagatcttcaaagaatactctaggttagctggtgtggtggaaagagcactggcctggtgggctcctggagtcctagtgtctagtgtcgactctgggcctcagtttcctctctactaaattgggagggggagagattgatctctggggctttttctagctctgtattctctgggtctgcaaatcgccttcagtgtctgccttgccagctctgtttgtcacaaagattaatccattttaactgtaccttggagtgcacccgggagaggaggatggatggattgttttgtacctaatattgcatcagaacttttgcctttttagatgagatcgtgccgtgcctaaaatctgtctgcctatctgcccactgactttgtctgtgctgatctcttgccacggtgcctcttcttccagcatccttctccctccaagatctagattcggcatctgactgtacctgtcttgttctctgcagcatctgtctgctacactcctagaccatcgttaataaactttcacacattacacgaaaacccctaatatgttggcacctgcacataaatatctatggttcataaaactagaggagaaaactccattttttaaagacctctatctagtgccatttgtatttgcactttttgtttagttgtaagttttaatagttccccctttgaggatttgtcagtacgagcagtattgcttatcagaacacaccaacagtctttttgtaatattcgcttttcccctttggttcagccgagcctgctgacagatcattcaaattcaattgttttatgtctaagccgaacagctaattaaagtagggatgattaacctgactggcagtgccgctctccctctcgcgctctctctccttctccttttctctctctctccctcctgttccaatcagtctttttctcacacactctctctctccgtctctcctctctctccctctctctctctctctcccccccctctctctcttccccctctctcttcctctctctcagtctctctctccctccctcggttggtgtctctctctctctctctctctctctgtctcttgctctactgtttttttttcctctctctctctcctaaacgtggtctgcttgctgatggcagaatggcactcggagatttgtgcattgtgtctggtttcctacgggcaggctgacccagtgcctccagggacttatcaatagaccactcagaagagacacagacaggagagaggaggaggggtggggggagagagagagaatcaatatcaagaatagaaggagctccgaagccattttttttttaaagaagtatcgggacttgggagagggtgacaaagaaggtttttcaaagaggcagtggaggaggttctaataaatttggaaggaaacagttccctgtcttgggaaaaggagaactcctgactgattagcattcacaccaggtatgagatgttcgctaccccttatcactgtgtcgcaaccgagatggaaaagcctttttttttttttaggagaccgagggagcatgtattttgctgtgtttgttgttggggggtaagaggggcggcgtgagaagctgtgggcatttgtgtatgagagcagaaagaatggaagcagtacaacggggggtgggaaagagtatggagtatgttactgtcttccctgtctttgtgcacccctggggggttacccaagttcatttctagcaggtggatttagacgggagttacttaacgcttgaccgccagttttgaaaaaaaagaaagaaaaaaacgctgcttcctatgtctattaaaggaagctccaatttctctctctctctctctctctctctctctctctctcccttctcttttcctctctcttcctctctctcttcctctctctctgccccccatccctcttcccctctctccctctccctctctcttctttttttcctcttctaaccagacagcgggagggtttctggctcccagccagcccaaaagcctctaagtgttttgcacttgtttcagggagtagctgcccggggatttttcagcattttcactagagaacaaagagttctttacaaagggaagggtggggggggggggagtgagcttaatgtctgatatatgtttttctatttttattagtttttcgcctaaaaagaaagagacaggaacagaacattcactctataaagacacaaagacattcaaaagaaatccagttatcttttctccccatcatcccaatatatacatatatgtacatgaaaaaattaaaaagaaaaagactagttaagttgcatatgttgctcttttctcctcttttaatctttccaaatccaactgttcttatgctcactttatgctattttttttctactcacaataaaagttgttcaggatgcatcttctcttatcatgtctttaccctttctgggtcgccaaaatcttgtggaagaaagaacaaaagtccatcaaataatcaatttggtgactagaacatcttctacttttgccacttgggtaaaaagttaattatggaatttgggttcccaaaataccaatggggtacatcagttcattcgatctcacaagtttttgcatccatctgtttaaaaggtaccacttgtgtcacttgtcagttattaagaaaaggtagtaagggagcagatatttgtattttatttttgtttctaattatgtaaatgacaaaacccccagagagatttcttgccccttctatgatacactagttcatgcaaaatatagtctagatggagattttgtcaacgattctgattgccacgtagctttgtgttctccatttcaatttttgcctatgcatgtatatttttaccatgaatttgtgttgtagcaaacatttcagaatgcttatcattttcaaattaatgctccaacaaaagcaaaaagaaatcagatgtgagctgtatgtgtaaaatgtagtaaacaattttatcttttatatatgctgtacatttatatctttatgctaatatcctggatttgtaaacccaagataatgttttctttcttaaagttctcctcttaatgcatttatatgttgattgtcacttagaaatctttttaaggtacattatagacacgaaactaaacaaggggaacaattctcaagctctacaaaaatccttaaatatatattatgtaccattcctaactacagataactgttttgctaagtagaaaacagctacaacagttgtttcaagaatcagaaactcttttctttttttttctattaactgaaaataaaatctattcatatccctggggagggaaaatgtaggggaaaatatagatatatacattttccataattatagaatgcatttatgtaactgcttcttaagggtgtaatacatatcagggcagagtgtgatgctcatcaaaaaaccctcctggctgggaggtgtgagtgccttatgtttgaagtaacttgataacaaggagtcttttcgggaaaccttactatgtatgtgttgcctcagtaatgatcctcagataaaaaacaagtactaggtggccagtgttagcacttgaactcactgaaagatattagaagtaggggaacttttggcaaatccagaattttccagggtaactcacttcttacacttacatgttttctttaggaatattcttgaattgctttcagacttttctgtatttttgtagaattttttaatgcttttaatagtgcttaaggagaaaaatacttttaaaaagaatgtcatccaaataagagaaactcagtctttaaaaagttttatattgaagacaagagttgttttggttttgcttttttcctttttgcttgtgttctattttttctccctgaattcttttgttgctgtgggctgttgtccctgcatttttaatttttcatttggtacccccccttttttttcttttttctttttctttttggtctgtttttgatgtgaccaaggggatctttgaaaggggcagagggactgggataacaggctgttactgaaagctgcactagctcttcttgatcccaactcaggcagctcctatcagctagttgtgccgccaagagtacagtgacaggtgatagctgtcattctgggattcttcgtggatctgacctgagagtgacacattcacagtcgaggagaaaagggaaaaaaaatagaggaggaggaaagaaaagctctttgagctggaatacactggccctttcttcctgtaggcaatccgctccagttcttggcgacgtgtcctgcactatcagatatcatatgactttttatttagattccttttcggagaatggcctgttaggactctgtttgttttcttttatttaatttccttctcccctcacccactagttttgcgtatctgtgtgtgtcatagcgtgtgtgcgcacatgcatatgtgtgtgcaatttttatctttgtttttgttctgttgatctgatgctttatttaaagacaaagctttaattatttcagtatactggtttaattatttgccaaaaagaaacctcattctaggctttttggggggtccatttttaaacacatccattaacacatgaggctggagatcctatatgcttgttggtctgcccttggcccactccctcaccttaatttaaccctccccttcatcagcatgcacagcagtataagttaggaaacacctgtgctgagttgagagagaaataaaagtagaagcaacttcttcaaatttgcactcctagtttcactttaataaactttttttaatcgttgattttttttttttttttggcatcctctgttaagcttgaaagcatcagagatagtgaacgatgtgtctgtggagcttttgtgaggccagctgagcacccttggaaagtagagcaggagctgaaattcattcagagacttaagaattaagtaagagatttaaataagatctgtgagatctgtgagctgttcagggtttggtgatagatggtaaaatggaatgcttagggatattcaaggaagagaaagaaattttcaaccaggaacgaaacaggcatttctactgcaattcatactttaaaaaccttcttttatcaaatttttattttatatatctcaaaatttaatcaattggtatgattgccttcttttccacgcttgctatgaaaaacagatgaattgtgccgatgttattactgggtttctcctaaatttttgttgtatttctttttcggctttagagagttctgattttagttagcaaaagaaaaataaaacttctctaggtatgcatatggttgtatacacattattcttatctacatataatatatcctgtttgtatcaggatataatttttgtatagttacatgcaagactgccttgaaagttcagatgaccattacattctttaaacccatagtttttagtttcttgttagtttctctaaaattattttttacagaccttaaatttgtaatgccttatcatagccagaggtgaattttgttgaaacttggagaaaaatttattccacccctttaagcgtacccaaaagggaagagagaactatttttcgttcaacaaaaaattttaaaagccttttttccttcagcggaaaactccaaaacagctttgtctcagaacgttaaacttggcatggataaaaaaatttgagttttgctttgtttgaggaaatttgtttttgaaacaacaatgttataaatatttttaaattgcctgctgagcatgcgctgtatctgactttattcatagttttaaacacacaccaaagtgcagtcttctgaatggccacaggtaaggctgttgatttgtatgatctttcgcagaggcaccttctgtgagtctactcagttttccagaagggaaaaaggcgagagctgagtttagacctggacacctttctaaatatcatagagcaaaagtaaattgccccattaaggcttgcacattacacttagggtaagtactgttcaactttccttttttataggagttgcctgccttaacttttcagcttaatacgagcagcgtaaattaagaaaaaaaattaactcaatcagttatttcactgaaatagaaaatttgcagattttaaagggtatctattgtgcataaatttggggatacgagaatttgccagtgaaatgatagcagctctgtgcttacagagcaaagatgtgctagtctgaacatgcctgatctcatctggaatcgaaagctaaatctaggtgggcctgtaataataccagaaaaggaacacatgtatcttttgtgcaacctttttttttttttttttttaaagctaggcttccaaagggaatgacaaagaagcaggttctcctcttgcttaataagtagtcatagtttgcctctggagatatgtatttccagttgttttagttgttttgttttgttttgttttgttgttgtcatcgctatcgaagaatattctttcctgtcagtgattattaacactttccgtttttcagaatgctttaactctgtttgatgtttcctcacttggttacctttctcaagtctgcgatgaccctctcaggctttgccattcttatcgattcttaccagaatgtacttactcattagctgttttgttatagttatggtggagataatcttgtttttcaggcttttataactaaccaaacaaattaccttttgaggtgaaatttctcatagttatccttgacacagaactgaacttgtcttgaaaaggcttgaagaaaatccaattagccgttttttgagaactgaatattctaataaatgcaaatggattattttacaaaatacttattgatgtgcaatgcttttctaatctgtttttcttttcgtgctttaaaacagaccctgaaaattaaatgtattaaaaagaaagaaagaaaaagaaagaaacctgccaggttaatactgatattttaaatacccaatttaaaataatgctcaaagtttgaatttctttgcaacatatcacctttcagtgtcagtcagtaatacctgggcaggtatatatatacattcacacccacagggaaacatgaatccactttacagttacattaattctattttaacctacaagagaaaaggttagcattactgtaaaacttttgttaattcattatattttatttttctgtaataaaaaattcactgaactattgctttcatccaattatatatatacttaacacccatttatattcaaatattttatcttaatttatgaagtatttttataagtcttatatgctgctgaattttatgcagctatatgaacgtttaagttttttctgatacaatttgctttgttccgaatctgttactgtgttagaagtttttttctttcccaatctagaaagagtatggccatcttttcctatatgtgatatctatacatcttcagtattctgaagaagagattttttaacctgcaatctcttggaaagctttcaaacaagtgggagaagtaatctttactttgcttctccttgatccatctgtttgccctcactgtaccacccgtcaccaccagcaaccctgaaaaaaacaacagtaataaatatgatacgataatttttctgatcacagaaccaggaaataccagagaaaattgtggcatatgtaggaaaatgccaagagcttctccagtaagatcagctgtttttatactttttttttttcctcttgaattttgtttgtgacttttttggcttgctgaagcacatccccataatcttacgaagccacagcaaattcccaatgccacaacaatactgtgcagccggggagaggccagaagagctgatcctgggtggctgcaggcttccccagcaatggtgcaaggcaggaggagtaagtaggctactcttcttttcccttcttacctaggctgcccaacctgccagctagagattttctttctgtagctttctcttcaactgtctgagacatttccttcaacaaccaatgactttctacttccaagggatggttcatatagcaaaacatccatttttattttatattgcaacatggaaagctttgaaattggaggggcaaaggaaaggggctcagggtatccgagaaatatcccaaatggcattaggctcaaagctgtttttcatggttgctcaggtctataactttcctgttccctccagagcctctaagtggttgaaagtagtgaatgggataactatagggtacacactatgatctaactgattcagtagatggagctcttctccttaagtctgtatttaaattaacgtcccactctagtttgtggggctctctcttttaaggtgtgtcatactacacacataaaattgaggcctgcatagctagagaagagatttcctggcgcttttcaagagacatgaagcatttgttctgaaatgcaaacagtgcaggggagcactagggtggggtgggaagggaaatggagtttacctatctaaatttctctctgtgtttgttgatattcttaagtgtgaaattaaatcctagcagttattgtggaatacacttattcattagctaatttgtaaatgtagaaaaatatattgcacatgcaggattttggtgatattcattgcaaatcttccaagctatctgaactgtgcagatctcctttcatttaattctacaaaagcatcttaatactgtaatgcagttgtttcatctaattagtctagagtacctgaataaaatgttacaagttctgaattgtgacagcacagtggagggcaaagtagtgtgttagtaaggtgcctttgtggaagccaaaatattttcagcaataactgaaaatagatttccagtatctgttttaatgggggaagagctacttgtttatttctttttaaattaattgaaatgaataattgccacagaatttttgtcagtgttacattgttttcagtaccaatagaataagtttgatcatgtctcttcctggtaccaagtggagaaatatatgtacactgtatgtaataaattatcttccttagtggaatgtcttctcacagattggagatattactgaatatctcttgttaaatcttgataagatcatttggccaaagtagaactggtcttggctttagtaccaaaagaaatagcatttttaaaagacttggatttcctttgcataccacgtgtctgagtttgatacagtccaggaaaatagagaggatgagatgaaattattcctaagcagccgccgtaggccaaacactgaaacagtgccaacctggaccaatcaggccggcttctcagaagatacatgcttttgtcaaacacttacatgaagaaagagagagaggaagttcgtgaaactgtatttgtatgaatattcttcactgatttcaataaagtccagggtaataaattcgatgatttttattcttttgtaaagcagaaaatctgagtttttctgggcagctaaggttctctaaatgttgtactgtgacatcttttaaacaaaactatcctttcgaatttaagcagtgcaaaacttctcacaaagagcaaagagtaaaattgatggaaactcagaatcaattccaaacccatttctggcatgatgagaataacatttgtgctgtgtttaaagtagtttaaaacaagaaaatgataaaatgatcaatatacttaaagccaaaaataaccaggagagaacaatctgtaatccattctcagtctgaaaccccacactacttatttattgaacatgaaaataaacaactatatattttataaggtggccctgcaaaccttataacatataaacagtaatgatgagatgccaggctttcaaccctttatttaagctatgtgtttagaatttagtcaggcaaaaactcctggacttaaactattatacatttatttgtttctacataccatgaccataaaaagaacaaacgttaaggaatatatagattgtcgcagtgaactacattgccaccttacagtttatgtactctgtttgttttaaaaagaaaaaaaggttttaactacagcaaaagaatattttaagttagaaagtcagttaattgatcaatatagaacagatttaatatttctttaaaaataccttgactcctgactaatttattaaattcaacacatacataaatgtaaaccatatatattttatacttattgctttaatggattgctttaaaagactaacttgacactaataaattttgaacctgtggattcaaggtcagtgaatgctgctgtccaagtttacaaaaatctctctagacttaagattttgctctaataaataattttcttaccaatttttcagaggcacttaactggatatatatttatcgatcagataaaataaaattgtccatctagatttttaaaattccagctgaagaacttaaaataacaacaaattgcataggcacacaatttcattgcactgaggtgctgtaggaatgatgataattctaatgagcactgtgacgaatgcaactacaatgaaacatgtttgattacatcagtaagagtgaactcagtgggcaaggtcagaagggtgagacatagaagtcatgactgagtgggggctaatgattaaagttatgggagctatttaaagccctatagctgggtgcaaaattaacagatgtggaaaataagagtcaatcaattctaaatatggacagtactttttcctataggttataattaactgtagaatttactattgcaaggatttataacaacatcataagctttggttgtccagtgtgatagtagatgtaaagagctgttatgcacatctgcttaaagatttatgtaagtgtaattgttatagcaacttgttatgctattgtttgaagtttaaaagctctgctttaagcgttgacaaagcaaatgtcagcatcagagcatcataatcactgtatcttggagcttgaaggggctttagatatctcaatatgggtgagtgggttaaccaactcttcagaatggaatattggaatatctggtcgaggaccatgtagaatttgaaaatacatatatattacaatgttttatatttggaaaacaaaatttacgagaaaaacttaacaaaatagagaaagtaaagctctacaaaattatctggactaatggtactatatattgcattctgtgaaccaggaattttaaatagagaagaatagaaggatctacattaaaacaaggttttatttttatcaaaaaaaatttgatgagggggttgtccaacagattaagaaatgatattcaggcttaaactactcattttgccaataagaaaacttaaacacagagaagagataaaatgctttcaagatgagcaaggcaaaactgggaccagaactcaagttttctaactcacgttttcttgatgtactcctatgccaaaaggctgaccactaaaactaatttataaaaataaaaagtaagtgatatcccactttgaagaagtggaagaaaccagaccctcagggtttctatttctatgccagtaacctcacctcggatgtggcagggacaaatatgtgtgatgaggataaggcattctgaggaatgaaggaaaatgcacccaaatgcattgtactccctagagactctggagttaacactgctgcccagacctccatagccttgtatctcacattttttctccctctatcgccaccaaaaaataaataacaagaaaagttttgagaaattgtagtcagaagatcttttggaaagaagtatttctttgtagaaatattcctgtacagattggtatattttactatcttatcaaagtatgagttctaatgagacattgatgattcaacaggtttataacattacaaactggaacaatccttgtttcctaagcacacaccacattttcccatccatgttccttttctcctagtattcccaaatagaaacacattctgcctcctttatttctacaacactttgtatcttttaatgagccttgccatatttcattttatatgcaagctatttatgtatttatttgtaatgtaaagaacaggtctacataattttaggcaatgtacttaattttactgggcctcacgttccacgtctgtaaagagaaaaacgatatctgccttcctaggatactataagaattccatgaaatgtagtatataaagtgcttagcagaatgactagctcaaggttatcactcatcattgttgttattgttattgctactattacttattaatattcccctgcctctgattctttcccatttatatacttctcgaggtcatagattgacctaattcattgtcttctcatgcaatgaacacaatgatttttgtgtaacaggaacctaataaaaatatattgaatctttttataaaagtccatattggacctattatttccctacaaagatccttaaatcctgtcctggaagtttaaaatagtggtggttatggccagtgcctgacccacatacattgtaaaatgcagtggtgttgcttgctgtggactgtcagagccacatgatttttcaggttccccacagacccccaacagcttaagactgctctttgcagcatccccagaagtgtcagcttatatttctggttcatgtgattaatgagcttgttacacctctgtctgtagcctaaactagaaactttcactttggagagcaggtcaagatatcgaatttaattttggttgcatctgttataagccaattgtgtattcattacatttatagattccctcttcagccatatattttcatggctgttgagagcacctgaatctgtgttgaatgtccttagattttactttggagacctgaaaatgagacagtgagatctttttgatagctagctgtcatctttggcattttcttccctttagtgtgtaatctggtctaaatttgaagaagagggcaagtatagcatttttatctagcttgaatatggcatggtaattctgtattaatgaggtcaatggtaaatgcagttcagctacacatttctgtttttccagacatacaaacacattctgtggaaatagaaaatgtctaaaaaatggaaatgatgaaataacttgagacatgtaagggtagagatataacattaaatgtatgggtttagcaagcagagcaacatacaaagtggactctgagtatgtatggatcttgccagtccttcaaggtttcagtggatagcaagaaaacgaaaaagaggtagatcacatgaacatggcagaagagagactgacagcagggtgtgctcaagtcagaaggaatgttacattttaatcagccagaagttccatttatttgagaataagctggtatttgtgaggggaacaaggtcacatttagtagaactgataattcaataaaggattttgactttgccagagtaatggtgttggcatcaagagaagaaagttttgcagatttctgtgtgtgcacttgctgttactggtgttcctggtgggtggctgaatcatcctgatggcattcaacaggaaccagctgctgagaatattaaaatgcaagcatttattcctctagagagacagtagcatctgcaaagttttcctatcttgatagtacagataatcccagggagcattctctagtagttttcactctctattcatttatacattttctttttatcattagcattaatatctcaagttctaaatgaagagaagagtgcctgagtcctgagtccacaacaggctgtagagatggatagttaacacttggccaagaacttggtattgcctcttgggctttaccttgaattgttatctaaaagggggaaactgacatttccctcccttggcctgtcttcaaagcaaagagtcatccatactcctagtcttcagcgagctccatcagtgtaaatcctgcccccaacaacccccaccaaacacgagctttggagcttttcactttacttataaaatttgtaaatttgttgctttccttgtgtgtttgtattttatttgtttgtttggtttattttgttttgttggtggttttttttgttttggttttggtttggattttttgagctaccatcaacagttaggggaaagggagttacaaaaaggaggtttggactctgtaatcttccaggtctttccatctctaatatttatgaataatgtattgaactgatggaaaaaatgttgaatatgttcattatgaattatattcaccggtgtgttgcctagaatataaaagagcaaagcagttgccgtgtaagtggttgcttacaataaatgtagtggtacaacagagctctgtatcccttctcattccaccgcgcgtcgtccccaaacacacgctttacatgtctgagtggcaactgcagatgaggtgcttgatgggatgacagccagccaaggttctgacgggtacagggacattcgtagtgcagtgggtcttaaacagaagcagccttgatgaaggttttgatagtgcagtttccttcaggagaaatcaccgaagccagtttcacatagcaaacattactcaagtgctttcatgctgcaggggttataactcctattaggagaattgaaacttataattttgcccctgatttttaaaaaacagcatgaataactaatttgtcagcaatgttacattctaaatgagccggagtggcagaaaattcagaactatttattatatttagcttcaaaattcattatatacttgtctctgttggtttttcttcataattatgttttgtttagaatttatcaaaataaaattgtattttctaagcatttaccagatgacattgagaaacagtaaccagaagcatgataagagacaagaaatctttttagtcacacaaataatcgacaaaagagataataaagagttaaaataatagcaaaatagtttttcactggccaaaaaacagtgaggcccattatttatcaaatatgtcaccgtaactgatatgcaaatatgtgccaaaatagagaaagaccatctaaggtcagggactcagagaggacagccctaatgtagagaatagttccaagttaaagcagttcaacaggaaggtgcacagaaagctctggcttttgtctgatatcccaggagaatagcagagtgttgatgagcaggttctgcctccaaaaagctcttccttcccatggtatcacttcagagcctttggactagctcttgcgagagaagggtccaagacagtactcgtaccagtatccactttatagtgacattaattcaaataaactgtcccagcgttatctatccttttaaaaccttttagaaataagcttttttctcccctatgctctctttagaagctgaaacccatcaaagcccatgaagagcaagtgtaaatttagagcaaccacatttatcaatagtttataataatctcagaggagaagcagagagaagaagaaagtaagagggaatgagagaaatagtgaaatttttttcaggaaaattacattacccattatttagatcaagtcactcaaaaacaataaaggatacccaattccatagtggtatcatgtaagagcagatgtgggaggatttttttttcccccagctccacccttccttacaggacaaatcgcttaacctatctgtgtaatagtgtatttgtcaaataaatagaaaaccatctatcctcatctacttcacagcagtattgctaaggctgattgtgcacacatatattaatgtatatatcgtagctatctatttacagcaggggagaatggttttaaaataaatgaatcagagttttatgtgtgcatccattgtgaaggtcagtcactttttaaaaaaaaaaaagtaagaccttctctgctgattaccatttgttaaaacacttgaaaatgatggctgagcctacatcacctctgtgaaatggaagacttttgaaatctaagcatgattatagagattcaaacacatttccatctacttatggaccctaatggccttatgcagagcagcagtacaaacctattaagccaaataaaagattagctttgccaatagatatcttttaaaaaatcctaaatcaaggatgtagcaattggtctagtgtcaaagtataattctggctgtaggagtgaactggttctctatattagatatttttctttaatgggacaaagatgtatagaaaggacggaattaagtttcaacctgtacagacatcctaggcatctgccaagctactggtctatccactcaagaagtaggctaagtatatataaagtccctaaggtcattggaaaagaggccacattcatttcactttggactgctgttattcttttgatgttggtctgagctctttaaatctctactttcttcatacatacatacattttttagacatgatgttaccctccaatagcttttcaccaggcccattccaagcatccaggaaagagaaacttagcttccatggagagtgaagtcatcgcttcaacttagcataataagaaagggagaaagcatactgttggtgaaatgagggagtttctgctaggctatgaccagattcttctgtttctgctattttttctctaactgaaaagagttattgtggtaattcacctgcacttctgaacctgtgtgcatacacccaagacctactcaaggtaaagccagaaagagattaagagcagactttcatccaggggactcagcttctttttagtgacttctgcttgttttgttgttgtttttaaataaatttgtgtttttagaaaatatgtttgaattcccagacattgatatcctgggcatccttaggttgtgacagaaacacggattagtgactgtgacaaatgtcgcagaagccagtgcagttgcaatctatcaaatatgttggcagaccccaggattttctgatccttgttgcagaattcagttgtgtccttaccgtaggaagacagggttaactgagagttttgagagttgtggtatgtgcttttccatttgggtctgggtagctctgggactggaataccttggtaaaaacaataactaaaactagggccagcttcatgggtatacaacctgtgcagttgcacaaggtcccatgtttggacgggccctatgcctggcttgatgtgcttctgttgctgtcctgaaattcttaataattttttaataaggagccctactttttttatttttccttgagccccacaaattatagagctggtcttgcctagaatttatctttccctagcataccaattgaaagtatcagtcattttttctcttactgaaaatgatacctttttcaattcctcaaaagttaattcctccattaaactctttgaagatttctgtccacataatgtggttcagaagaactcatctctccttctttcctccaagcaccttgagatgattatgatcaaggtgatcttgttttgtaatcagaaactctatagctgtctcagccaagttttgttttgtttttttttggttttttttgtttttttttggcaaggagtgaatactagggagaaatagttgtatcatagtagtgagggctttggcctttattggatcattaaaataggcttcagtcattaaattgatgttttaaaatgagcacctaacattaagattatcttagcctaggtacctcccaaccatcatgtgatcaaacacatccgtgtatgctaaaaacaagctgatctctcagctctggccctgggcttctgcctctctcagacccccaccaatgccactgctagctatgtgttctgtggccttcccctcatcttcccttctgctttcagctcagatcaatccttttattcttcttactcaaaacacaactggcattagcaggaggcagttcctcgcttcagtctacatgtagcatctaaggagactacttcttgctgagttttgtacaaacacactaatgcctgccaccacattgatgagtgtgaattacagaattgtaaggcctggagcagaccccagagatggatgggcctgtccacactgacagtttgttaggaccaagccttaatccagaaaatgtaggcctcctgactcctagtcaggtatgctttggataactcaaggggtgttcgacattcctgaaagataaattccacatgactggctcctaaacctgttttcaagcacccatgagtgaaaggaggaggagaagaaaaagaaatatatacatataaataaatattttgtaggagctgagaaaagagtgctgtgtaacaaggagcctgactggccaccttgagctctagttagctgcttcaaccctataaaatacttcctattactaataatatcttcagggctgttggaaggatctagagagatgcttacctaacacaaagcctaactcacttggaagctgaggaaaggttaatttcttctacctcttcctcctccttctttgcccttactttcacacattttttcctccctgctctaggaaaggaaggaaaacagaagggatctgatggagagatagtctttgtgagtttaaattatatgagattaagctactctcacctcaaccaagtaggctgtagtttgctgaccgcctgttgagcaacagcacaaccatggagcaacagaagagccaaaggcatttttgataaaccatgacatctctcaagggatttttttagtggttcaccagctccagacaaggccctgggcaaaaactgcaatagagactgggttcttttcagtccttgtcacccacttcatcttctcctctgccagcagagcctagggtccttgtgttagttaatctgattgcttccttcaccttcccctgttccagaattatccctatccctccctccagctccagttcaaaactgctttacactgagataactctcttggagttgaagtggttatagcatgaaggcatgaatggcttgacccctccgtggtatgtttgcatctcagaagaagtgctggaaaaccttttttagcaaggggacttttcttcttgcaggctcacaatcagctatgttcccaatgtgactatacccaccccacccctttcttttttgttttttaagggttgaagtctggctcaatcacccaggctggagtatagtgccacaatcatggctcactgcagcctcaaacttctgtctttgctgtaatcacacatgtgatgtgaactcagaaaagcaaactttgttcctggaggaaagagagggagggaatataggtttacatagtgaataaaacccagtatgatagcaaagggtctctcttacgaaaatataacacaatattactttttttgtatgaaaataagtttctatcttggatagccaaggccttaacaggtaacattataagagtactataaacaaatttaaaacccaaatgttttgtgataagtcagggcttctacctcctgtgaactctgggcattttgcaaatttgaataatcagtcatctcgagtctcctctttttacagatgagagtattgaggctcagatgggacacaggttttcttctgggtcaccaaactcaacagcagagctgagtttggggcccttgggcctctagggagatctagcttttctgtctgatacgggaactcctaagagcacctccatccaccccagccagctttcctttcttctggtcatttctctttaacagttgttgctcctgcactcatcaaaaaaaaatgtcagcacaagaatcaaagggaggctatggagcattagagaaatattagcaactattgaaaagacattttgacctatttctgtagttatcaatttaatagtatttgttgccaggaaatgcaccgttggcgggtgggaaggtggattgcaccagcagcctgttctcagaggccctccagttacaggaggtggtaattccagttaataaaagggtgaacttcaaacacattttaaccaaatcaaattgtagcgggaaatatcatattactgatgttcaagctgactcacagctggtaacattagtcagtatataggccccaaattctgacttttcagcattttcagatgagtttctggcagtgagagagttccccaggcacattgttatgtaggaataggagatttttagctaacataggagctagcataaatgaagaatttttttattctcgttagactttttataagattgtcagatattcaaataatatgtaaccaagccaaacttcaggttgataggaaatctagagccaggagttttaatttttttgttgttttgtttttttctgtgacatgttggcaaatgataaaagcaattcactctgctaaccagagatgctgggcagaattcccccaacactgatttcatgccatgaaaagcacatgaagtctggcctggcaaggcatggtgaggagcacaggctttgtgtcctactgctccaatttgaattccagcttagtccctactagctgtgtgaccaaaggatatttacgtaacttctctgaaccttaggattcttatacaaaaaaaatgggcaaaatatcaatcattcgtagttggtatgaagatcaaatgagataacatatgtaaagaaatccatgcataaagaaaaacagtgccaaacgtgtaccaggtgttcagaagtgatcactgttatcttcctcccttttgctgctatggtgtgcaagtttttttttttaaagagttaattattttccaataaaatgcacagcttttcatatgataataaaaggaaatgctgctggatactccacagattaatctggtgagtcttgtttgagtgaatggctgtttgccacctcattttagtcccagttaagcttagacttccctttattaacctctctccggatcatacatacaataggatacatggactacatgataaatcaaatggccccctgataacacagtcccaagttgtgtgagcattggtgagacaatggatcatatgaatagctagaaccgctcatctctcttccacatgtgtcctactacacctcactttgaatcaggaaagatgccagacacctttctatgggattgcctcccacctggattttttcctaaactttttccatgcgcctgaatctcggttttcacagagattaattctgatttggttcgcctacacttttgatgctctaaacctttttattgttggcagatagtctcaaatactgtgtttgagaatggaaaaagaaaacgctgctcaaatgtaagcaccattgaatcaaagaaaccgtattttttcaattgcattatttgaggatccagacaaccttgaatcctttacaaaagcacatcagtaaggctatcctctctcttagaaagatacacacacacacacacacaaacacacacacacacaccccaattgcagaaggctactcttcatgaggtaaaggactagagtgtccaagaggaatacaaaatgaaaaagatgtttctgtaggaagaacccagacctagaagccaggacattcaaattctatttcccactaccatgggaaatacgatcttatatggatcctagcatacctgcctctcccgaactccatcgtcacatctagagaacatggattccaactcatactccttaggggctatcaggaaatgtattttttgctgttttgaaagacattttgatacccctaccgagagcattttgcacaggccaagtatttccctcatttggaagactgaagccctgaattttacttcccatcactctggaatgggtaaaaaactgaactttttacactagtgtgggaagaaaatgatgttcttataatgccaacttctagcagggtgttaataatcatctaaaatatctagaactaacacagacccattgacctggtctatcattcaattgacttccacttttatccatgcatgtttttgataaacattaattatggggtgacccagtgtgagaggagctgtggacacagtgagcacatccctcccctcacagcctagctaaccctccaatcccctaatgcacatcaattgtaagttgacttaaagttgtacagatccttcctttctgtgcattgagtcatttcagtatgtctatggaggggtggttctatagccaggaggacttgcttcttccgaactgctaaagcacttatttgtatgtctcctgtggcactgattacatactgtcttatactagagcatgtttatatgtctcattcctcctgccactgcacagtaagcttaataaatacagagactgtacttacacacagttgtatccccctcaacacctagaatgtgccatcagaaataaaaggtatagtagtaaatgttgtgatttgaatgagtgaaattaacaatggcatgtgagtgtttggaaagaaattaccttttctgaatccataaatttctactcagaagcagagaacatcactcagttacatcagaaaagcttaaggatgttttttctttccagtttattacttataggtttcattcttccccactcttgacatttgcacatagtaggtttttaataaattattattgatgtatttattaaaagtatagaataaagtagaggtgtcccactcctgtcttctaaaatagtaattttgattttcatctacttctttatcttcagaccttgtctattcctacagcacagatatcctgggatttcattccaagtggttcctgacttgagcttagacgtggtcatgacttttaacttggcctctttatcaggcttcttacagggcagaaggaaaatcttttttttctgtttcctcgtctccctcataggactgttgtatagttgaaaaggacctatatctacgtaaaactattttaattcctagagtaacataataacagattcataatgtcagattgaagaagctttggcatcccagcacaccaaatggttttgtacaccctgtttcaagcttatccatggacctgaggggtgaggagtttattactctaagcttttaggttaggttcgtatgatctgtaccagctacattaaccttgacctcagtccaaatgaggtagctgatttaatgtgtcctctccagtcacacaaaagcttcaccattactctccgacctgattagatgctaaatttcatccacacaaaatgatctggaaccagtcgtcttggtgttaggtcacaggaagtgataccaaagaattccaaaataaatacattattccagttttcctttggttcttcctcaaaaagtctgtctcacagcaggctcagagagccagtccctcctcagctagacattctgttgagtcatgtttactgtccccctcagaaaggttccaaaagcaaatgcaagaggttgccgaatgcagggacatgtggcgtgcatgctactgaagtgagaggcatagcacacacctgctttttggctgtggcaggccatcttgactgtgccatgccacaagttagcattttggatgagcaattgccattctgttgttttcttctcaacacatggtgttcaaaaacagttaaaagaaaactgtacccatttgctcatcccagaaatctaaaatttcaaagaagcatgccaaattaattttcacataatattttccaagctttttctttgcactgagaaatggtatttcactttttgaactcttggtgtcctggcctgaggtaaatgggtacagtttctctttaaatggcattaaacatatcaaagcaggattatatctgtcactgtctttttttttttttctaatggaatcaaaatccttcagggagtgtcccaaatccacattaatgtctttgagtgctaatgtttccactgggacttttacattagcaaaatataagtgtgtggttttcccccctctctctgctgtctgtataagaaagagacaactgcacatccgttattctccatggccttcagctaacccatgttaaggtggtaaaagatgactagagatttttggtgctaatgtttccttttctaccttttcactcctttgtgccacttgaccgaaaagctactgtgaatgctgtttccaacatggacaaatctttggaatcccagccatgaatctttgaaatcccagcatttggtctgttaaacagaccaaactgcagtagctgtcaatgctgtttttacctttggttctgattgtggaaaaattagacaaatacccagaactttaggatctcactgtagatatttttgtcattaatattggggtatgagtcatgtgtcctttttattgttggtggacgcacttcctgtctaccttaatccctctttttttgttctttagcaaagcagttcaaatggtattttgtcaactcttgattatcaagtgtcaatgaaagactacaatgtcataaatagaaaataattgtaaataataaataactttaacataatgaatcattagctgtcgtagtacatttaatcttagaatgcacctttttcttgcatttgaacatgctctggaaaattacattatttcttgaataatcgtttttatacgtaatgtagaaggggctagaaagctctgcaatatccgtctctgacccccttccagagtttttcttcttttagcaccatcctgcctactgagggttttagttctggagctgatagagactcttcatccatggagagctgggaggtgccttgctcttgaggctcacccttttcatcgtttcactttctggagcactctggaagactacactacttccttagaccctcttcctatccttcctccttcttcttctgtactttttcctgctttttctgtttttcgttttcttttcctatcccgcgtgaaactagaacgtgaactggggtgtatgtttgtgtggatggaggggcacagggaggaggggactctccaaatgccccagcttagcacgaggagaaactccatgttttcatttaaacaacctttccccacatctaggccttcatatatgagagaaaaattcacttgttttcctttccacactttacagaaaacaaggtaagtagaggcagtgagaatgccaaccctggagtaaaaatgaagcagactatgtgctcacctttaaatatttttaaggataaaaccctatctactggcagttaacagggaattcactgtgccaggtttttgtaggagcagtgcatgatgttccctggcactgaaagagtttatagggtattttttatgtttttagcattaatttttgcatgataactttgcaacatcaggtaaattgtcttctaaaattaaaaaaatacatgagtgatttgaattttctacatcaatattctatggtggatccaaatgttagtttgctcatgctcatatatttaaacatcaaggtggcagaaaatgtgtgtttatattcgaattaattgggcacataacttagcatcatatagtagatatccaataaaaagactgccagtggcattcattgttgtttcatttttgggtttctcccttagcaggcttataggctttgtagatggacaaacttggatccaaatatgagtgccataaattactttctagctttgtatgtctgctcaaaacacaatcttgctgtgcctcagtttctttaccagaagaaatggaaacaatctctgctctgggagatgtttatgagaattaaatgagctaatttgtgtaaagaacctagcatagtactgaaatgtagtaggcactcacatgttatctttctcctttcttctttttaagagaaatgcttgggtaatatgatcacttctttactactagtgatttttctccataaccagattacttaaactaattgtattcattaggttttagctactcaatttttgttcatctcaaaggaaatcattgtgctttgccatatactaaaatataactgtaagggaaatgacttggagattaagtacagtcatcccttgatatccaatcagcagggcactggttccaggacaccccatcccaccccagcccaccacacagataccgaaatcaacaaatgctcaagtccctaatataaaatgggatagtatttgcatataacccatgcacatccttccgtgtactttaaatcatctctaaattacttataatacctaatgcaatgtaaggtctatgtaaatagctgttatactgcactgtttctttgtttgtgttatttttcattgtggtatcattattttttattggaggttttttttttccaaatattttccatttgcggatatagaacccatggatacggagggccagaggtctgactacaaatgtgttagatctgaaagaagcatgacttagcaacgttctctgccttattcttagtttcatccccatcctcaacctcaataccctctcagagactgggcagaaggagagcagcaatgcctagagagctctgtttctgagctaccgagttagggcattgaatttaggatggattctaaagggaaaaaaacatccaaatgcaccgaatagctgaaatccaatctttagatgtggggtaccagaaacattccagattatttccagtgtctaactaaaatataatgcagagtttatgccttctctcaagattcaaaattaatgattatgatttgtattaatccaataggaattagtttgactacttgattatttaagaggttgtattgtagatataaaacaactatactgttaactctttttgaaacagcacaaactatgtctaatcgtacttttttacttttataatacttgcacacagagttcagtaactgtttgttcactgaacaaatgaatctagtccgtggcttcttgaccatggtagtgaaaatgctacaacaccggtcctctttttactacccagcaatatattttatacagacttatctatatctatagatctctccccctgtatctttttttgtatatatatgtataattgtttaaataaaaggccttgaaggacccaattccactggattcctcatagccccaaatctatctgtaaattcattactgctagaattgccaactacagaattaacttctgtgaccattggcaagtcctcagtttcctcatttacaaaatgactaaaagatcactaaggtaaaaaacacttcccactccagaatttgattctttctctctagtgagaagtcatatctttttgagaggtatcctattgtttgaacttagcacaagttttttccttgatgcaagaatcacaaatgaaattatttgtattctactaggggctggggacttgtacttgcttttaaaactgtttcaggacaaccattgagataggtgtcttttcatttctttacttacttagacactgggactcaacatggtgggggcagccagacctccacaggagcctgccaggtttctgtcattccccccacctaccaaaaaaagaaaaagactaaaatctacccagttccccacttctgggccccttcagggcacttcctctttggtgcaaatgaggcctgtccctcccagtctagctccatagatgcctttctggtgtgcttggtattaatgacatagtctgctttcgtcagccttaccatttccggagtgaggtatttcttggtagtttgcatttttttcttttaatacctgcgtatttaatgttgtgtctgatagagtctgattgtccccattgtgaacgtggtttttaagtcattaatatgttgatttggttcgtaaaagtgagagtaaactgccactatggtacagtactttgttggggggtatgggggattctctctattttctcttctttttacaagaagaaaaaggccccaaattgtgccctttggattatcttgttctctttttacatttgaatttcaaaatcccctttaaatgaacaaatctcaaggtttctattacgacagatgcctttgggcatgccccccagtccccgtgactttatggctgtgggcacttcttcctttcagctctttgtgaatattctgtgtccctggccctctctcagagtcacattgacattcaaacaataacctctcccttagttggtgctccttgattgccaaaacgagtgctctgcctctactgctttacctctgttaacaatcattctccacgtttctgaagaaaaagaaagtcttaacatttaatttcttattacacgatacattttgattaacacccaagtattagatgttggtgagtgctgaggggaagacccagacagcagacaccaaatcttatttttggagactatttacagtataaatgtgtagtacttgggggtgggcaagtcttgcacatttgaataaaagaggaacagagttgttgtctcatctgtgtcaggaccttctcctcttcggtctgcattgcagtcctgctttggcttaattaatccattaagctctatcttaaccctagtcagtaatgatcgaggggctcactggagccatctagaatgggagaaattagatggataatgatttttgtgctgatgatgtgttctgtctttttatatagttgatcccgtgagggacatatttctttggtgtattcctgctgatgttctcaagacagatatattacagagaaataaatcagactatgagactttgctagtgtctacttcttggtgtgtaaatttaacgttttaaaatcaaagctgtttttaaaaatatagttttatgaatataatattaaacaatcaagagggtgagagaaatttgggaaactctcattttggtattatttcttgttacactcagatgctgctatggaatatttatgttcatagtcttctgattccttcctcctctgtgagtaaactgtttaagatggttcctcctcaattcaattcaacaagtgtgtgtttagtgatacctatcatgtgcatagcggttgacagatctcaaaaagcatgagacttaaatggctttatatatattaaagtaacaaaatgggacttttttcatttttgttttttataccaatttgaaatcaagacttaaaagttgcaaggcaataaataaactgtattaaataccatattttgctgccatcaaaataatttataaacaactacaatacacaattaaaaatataatttttttctgaaatgtgtggaaaggtgggtggagtggttcttaccttgttttagagggttaacagttggctggtaatcatcttggaaatctctctggcataagtgaggtttaagttatcatctgaatgaaggaaagatgttcttcagtgcatgagggattattccgtagatgcaggcttatgtggaaaaagttcagagatggagagggtgtattctcagcggaaggaagccagaagacaaaagcgacttgctgtgtggattaaggtgggccttagtggcaccggatgctgacaggttagacaagcagacctacagggagggggctttcagtgctgggagtctataattcacaattgatctgaagtagggtagaaagccactggaggactaaagagggaactgtgacagtcaaaccattgagaatatgtttggagtgaggaggcaattttttttttttttttttttttttttttttttttgagatggagtcttgctctgtcacccaggcaggagtgcagtggcgcgatctcggctcactacaagctccgcctccaggttcacgccattctcctgcctcagcctcccaagtagctgggactacaggcgcccgccaccacgcccagctaattttgtttttgtatttttaatagagatggggtttcaccgtgttagccaggatggtctcaatctcctgacctcatgatccgcccacctcggcctcccaaagtgctgggattacaggcgtgagccaccgcacccggctgaggaggcaattttcatatcctaggtacaatgtgattaggagctggccaagaatattagtttaaaaaggtatatttgagttaacatcatcataagaaaatttctaaatttgataagtggctctatatgagaagcaatatattaaaatgtgaacgtttagcagaagattgaggcattggatatattagactgtggttacacagaatttgtatagcagaatgatttaaaaggaaagagagaatgctttttattatttgggttttgaggggctagcagccatctaagtagagatattctgaagagaaagtgttatctaagttaactaacttagttaaccctaactaaaagaggtagattatgagaaaagatggatgagtgcatcagcccttcagatgcatgagtataagaagaaaaaactatggccttaagatagttctttgagggacagcatatttaagagttacaaaaggtaatattgaggaaataaatgaagggagaagattgagccaagattataaattatagaagccaaagacatagaaagaaatcattttgagcgttttagggtaaaaaagcaaaaaagggctagaaggaaccctgcaggatcgtctcagtcagtattcaaattttgtgtattgggaaaaggagacctagaagacagatgtggtcgaagtaagcagagacaacgtgtagaagaaataggacttcaagtgccccttcacctctgctatgctgcctcagtgggggacttgtccagtcatctcttgcaaatgtcatgatttaagcaaagaacagctaaatttgtagagggccaggctgacacaaactggcttttgtaaatccattgccaagagtaagggagaaggcgatattaaaatctctatcactgcttcagctgtaaacagggtggtcagctgaagaattaatggtttttcaaatttcagagcgacaccttgttgcctactaagtatcagaatcacgtgcataagagggcattcagatacacagctacacaattatgtaatggttttcaacttggtccttaatatggagggaaaattctagggatgtctgccaaattaaaataattaaaattgaacctagacttaattgatttaaaaaaagaaagaaagaaagaaactgaagaatccttcactctgtcctaaactgagaggccggtttgctttacaccttgaccagctttcttcagaatgacagtaaaaggacttggtcaatgccatggtacaaaagatgtgccatgccttgcttactagatatttttaaattgcttcttttctttaggaagacctcctaagtttcacctaagtaaagaccgtaaacttgagcccatgcaaactacaactgtaagatcgtgcaggggatggaggttctgtgcaattgtgacacgttaaacggggctcccctgcataatgtgatccctgtctttaggaatagcgctttgctcccatgttaatacattctggaaattgctcaagaggcagctttggcattagaatagcaactttcaaagcagtgaacgtcagcacttctatttctccttctttttggcgtgcattacatgaagctggaaggactaattggctaaatgaagggactcagtgtcgcagagttgaaatcctggcatgtaaatggagaggtggggagagactttgcatgcatatctatatggcctccctttgtgaattatcataatagaaatggttctgccccttctctagtttccctgcgagatgagttggggtgtgaagtgcatggcacagaaattcaccatgctttgtatctatgattacttgtgtctgtgtgcatcttttccactcctaaattgcatgtttacccaaagttgctgaataatacattgtttcaaaagatgtgtccctgaattaaggttgttatgtgacaattataatatgaccgtgtacagctgctaacaactgtaaagaaaaataaaatcagtaagtggcattttcaaaagcaaacaaggaaatcgcttatttgttttataggtgttagatttacttccttgacctctgccaagcattgataaagactggtcaataatgggatcaaacagttcacatgaggttggttccctatgaccgtagtcaacttagcatgtgggatggctcagtcattgaatcatacacatacattttatgaaagagtatttcaagataagctctacagatcatttttaacttttatgagatgccaaagcctagaactcttctggttcacctgtcctgccctctagtagcatgttaactaaattgtcacagataaatagggatcaaatgtatttcataaaacttacactggaacatcagagtatttcatatgaggatttaacatctcctgaagtatgtaataattttataactcaactcaatccctcatacttcataaaccccctttttaaatgtttaatctgagttataggtaaggaacatctattaacacatcatcttactaatgaccattatcaaattatctctttaatattttgggcaaacaaggaaggaaggttctttggcctttgctctgaacccttgctaagctttccccatttccattaagtatggaactttgaattccaaggtataaaacacagggtgaatgtaagtcatccacttctttgttaacttttgttaacttctttgttaacttttataagcattttatttgtaaagcacattttatgcttagttaagtctatgagagctgagcctgacacaccagagtgatgttctgtagtataaactccttacagactaataattgttgatcagtgagaaagtcatttgagctcactaggtaccattgtacaaaattttgtggttaaagagtgttccatggaagcttgacagtgaaagagggagttagtggctcaactgaaagctcagtgaagtttagacattggttaaatcaaatttgagaatgccatatttgatttaaagattaaatattaaaatgttgccctttgattatgggagaaaagggcttgcctggggaagaacatgggtagagctaggcccttactgccaaatgatggaaaataccctttccatgttgccttctacccaggaggggtgaagtagactttgactactttgccaatcattggtcatgctgctgtaaaggtaaaggtgactgacccaaaatatatataacaccatttttttcagtagcttatgatataatttcatctcatccatcaataaataagaacacacaggtgtcattctccccaaatgagaaatggaaaaattgaggctctgtaaggttcagtaccttgcttagtgttacctaaataatcagcggttacatcaaaaccagaactaagtttgatgtctagaagctacagaatgtaattttcaggaccaagtggaacaagttatgttcagtttgattttaatgcatttcagaatctggacaacatcttacaaaatgtctgattatatcctattttttctgtagatttctagaaagggaattacaattgggggtgcagggtaaatctattttctgacagtggtatgcctttgctcttacaatcttatcagctgaattgagggaaaattcatattccatgtcaaattcatgtaaggcgggtaacgtccggttgcagtatattcacaaaatatactttcttgctgtgtgttcataaagtcctacttcacagccacaaggtttgtagatctttgacacaagagaagtggcagcaacaactccaaaggggactgtgtcctttgttgtctaagagtggcttctaggtgagctttgaatcccattgtgagaattccaggagtgtggaacaaaataggaaagctatagactgagcagacgatgtagtggtctaagtaaaatgtagttagtctttcatttctcttcattttaccctctatcatgccgtagtgagacagaagagctgatttaaatagtgaaagaattcttctaaacttcatctacttgtgtgttcaacggggctggagggaggctataaaagaaagtcatggaacagagctatacttgtgcttgtttcatgccttgtagcagattagtctttggggccattccatgggagattgcactaagatacagcccgaaacaaagtgatgttgagtgagagggagagacagggtggtgtcaaccagatgagggacactggaggagagggaatattttccctgaaaggctcaccacccacgcagagttaaaaaaaaaaaaaatctgtagtcttaaaatgactttaatgtcttattttttccttcaccaggaaattaacattcagaaagttatgtttttgaatgtgtcctgatgtatgtctaaatcaggagtacatttttatggctaggttataaacccatcataatagtgaggggttaaaatggaatgccttcaaaagataacctatacctactgcaggcttgaaactcgattagcccagctattaaaaccaggaggacaaactgtttcttccctggattcaaaagctgttaggctacggcatgacccagtacaaaagttttctgaatctctctccactttacaaaacgtcggctcattgctgccgtctgcagtgaagctgtttacagctctgtgctaagtggaaagttcaaatcaattattgtccattagagtttaggtataactgatgaaatatccccagaggagtattgtaaatgtatcaagacgtccttccccattatagaaatggggacgcatagtgaattacttaccttctctcttacccttaatgcctctgaaaggctgctgggcagacagagctcatcttgtcttgctgggctttaaagtgagaactttaccatttggtgaacatgcatagtgagctggcaaaaagtaaatttcaactctctagactatcctgtggacataaaggtctaagaaacaaaagataggaaaagccctaagaattgattaaagccaaaacccacaagttccctggtaatcaagatattttagaaatataagcttcttattaacaatcaaatgagaaaagctttgactccaagtctttagcaaatgatggtatggtttaatgccaaataatttgtgctaggctactttctttcataaaactggttctctagatttgtctgtatctggcttcagcaggacagaaaaggagacccactgacttctcaagtgcaagagagatagttctaattttccagaatctgttattcagttatagagtctaatagtgacttccacctcataaaggccagaactgagaggaagaagagggtcttatttgtaatcttctataacatgagatggaatagaaggcattttacttccttttagagttgtctttacttattccctttccctagttgtgccccagagcaatccctgtgccctagagaccctaaggctgaaatgcacagggacttgtcttgacatgggaaagactggatagtattcttcagagtgctatgatttttcaaaaaccagagaagagtcagacaaaagtcaaggagacatcattctcctgtatcaacctttccttcctgtatgtgcacaggcgggcaagacacctttttattcgttcagctccaatgggtgccctacagggaagcactggaacataattccaacccagactgccagtcgcaatggggataagaagcatctttaaaatgcaacactgatttctttgtgtttctttaacaccaaggataactccaaggatgtttctttctgctgacagctctgtccgtggtgctaagtaggaaattggctgtatttcctccttttggcccatactgcttacccccagctctcctgggcttccccatatctatctatagagatgctaattgctatacagtaaatctagttgagatgaaaacaatgcttccaggatatttatcaagttagattttcttctagatcactcaggtaatgagagttttcatgttgctttgtagctctatctagataagtctgttgctctttttaagtttacaaggagaagtccattgggacctacctttcattactaaaccaatacttttttaccaaattatgtactgtaaaaactgtcactaactcagagagcgatctgggccatgcccacccagttcccctcccctcaagtgtacatctactcacatatcaccagcttcgaacaatttatgatatttaaagatttagccaatttatttcccacattcataataagggccattgccctggtgcactcagcatgcacacggtatgtttctcttctttcggatttcatttattctctttggtatgtcagttgttttggcaacgtagattgtataattgtttcctcttggtgttttaggagaattattttatatgctaagtgtgagactaaaacttagtgattaaagtctaaatcctgtaaaataattaaaattatacaaagaggatggccttcagatttgtcctgtgtcttaatgacaaaatgccaaagaactgtacaggtccctatctttcttcattgggagtacagcatctgggtgctacacttgaaaagcagcctcaatgtgacagcattaaatatatacccacagtaccaaatgtgtgtttagagttattttcctgccctattactatgtgtttagtcagtcctttctcaaatcagcttccctgttctgaaacccattttgcttgccctcttctgactaccagccagcacacccatagactgctaatacgcttgctcagagttaaggagcagtcctggttttcaagtttcttgtagccattatttgtgttccaaattatgttactgtgtctgtattaattttatgtttctgaaagtgaactccgtgtatttcaaggcagcacggtttcttttttgtattttccagggaactggtgtttttaatgtcatgtgaggacaacattacacaatggatctttggcagggatacacagaaatgaataccgtgtgcgaacaaacattaaatggcagtcttaattacagagtttgattctgttgtttttaatgcccttcaattttataatttgatggaaaatgcatcaacacagctattttctttctaccctaaatgattaaagattgatatacccccaaaccagtagcttgttagatctggttaatcaggtaggtcttacatttcatccactagagggcagtagggatacacatccacagcaaccaatatgtgcaacatatggtcgatgtggaaacatagtagccatagctttcctgtgtatgaaaaattcccattacagtgttgcttcacttataattatattgaaagtaaacactaattcacagacggactacgcatattttatttcaacataccccactagtgttttgtctattctactttaaaatgccctgagtaatgaaacttctactacttcccttgggaaactgtatcaaaacccaactgttctcactgcttgatttttttttttttaatatactcaagatctattagtctttcttctagttcatttataactctattgaaatctattccattttttcttatgataaggctagtttcattctggaaagcaaatgtttattgagagcctattgtgtgtaagatatcactaagtgaatgtatggccacaactgacaagggttgcaatacagaatttgaataaatttgcatgactcagaaagctaaagaagaaactctcccaggtcaaatgtcagaagaaaagttggtctcagttctaaaatgagtaatagccataaggctgtcacagcttggggaaatgtttagttgtacttagatttctgtattgaaattcaaagggcatcaggaatgcttggtaacatcagataacacctaaagaattgtgaggtatgcagctaacacatcagtgggttcatgccaagcaaatgacctggaagtttactaatcaaggttgatccttcttcctttcacagctgatggccagattagcctagaagtttcagaatctatactgagaatcattatatgcatttatgaaggataggaaatgggttagtgaatttacccaaggtgggcgtaccttgattatgttgcattgtctattttctatcatcgactttttgggtccaatcttggtcactacacacactacacaatgggaaagcgatccaagttcatgtgcaatactctggtttgcatcattagtttcttggcatatactttgattattaagtatctgaaggggagggtagaagaaatccaagccaagaaagttcctttaaggctagaactcacaattacacacttgtttaaaagtccttttttcctttacattaaagacagagcaagattttttgctctattgagtatattcatctggaaggatttccataaggctgtcctgatcactaagagcaattcccagatagacgtgtatgcaaacaagaactgttcagactccaagagcaaaaattgaacactgcagaaattccagaaatgatactaccttttatattaacgtcctttgagcctctgtaggaagtaaactattctccagagtttttgaaataaagcactttcttttgccaattaagagcgcaagaatgtggtttcatagactgtggtttcattttcttaaggaaaatagtagggacggttacagaatcttcgtggaagtctacacaataccataacccaggtttctatcacaaacaaagcttagatttgaaatttatgtcacctgtaataaagtccacatgagtgttttctgtggaagtaattaagtgcaaatgtgcaacagccatttttgtgtttttgtttgtttcaaaataccagaggtgattaggccatattatgaactaattacttacttaatttatttaagttgaaacgagtttttgagttatacgagggccagaaacaagaactcgttaatccattctgcacatcactgaaaagaacaaaacaaagaagttaacgcctttattttattatgttacaacacactaatattttgaacactgatgaggacccaagtggtcaaaacatctgtatttggtaagaaaataaaacaaactctttttttccaccaccatttggttctttcagtggtgtgctgaaattcagaatgaatcaccaaaggtattaaaatggtgtgtcctttttagtacattttcctatggcatttaaaagattcttcaaacatatttgaaaatagtaaataaatgacctacaaaactcaatattttcttaaatttggaagtaaaccacattcattcctgggcttgggactctatacaccaagtttcaaaccggagcatattttggtattttgatagttgagttataaccccctgaaaagagggactgattatgtgcagtaaggacagctgcccatggagctgcagctgagctgctaaaataaagctagtgtttacctgtcgctgctgaccaagagatgtgagactcagtagatctgttctgtagaccctaagagaagctctgtcagcactctgcgattgagtttcaccgtctgcgtctatacttagccagcttctagaaggggagaaagtgggggatacaatacactcatggaagcaaaaccaaaacaaaacaaaaccctgtatgttgcaagcaaattgaaaatgtcagagaatatttatgatccaaggttacttgttctaatgtttgattctttatcttccaggttctaatccctctatttagttagttgtttttttttttttttttaagtattgctaaggaattgaaattatcatatgtctgaccacaatgatcaggtggttgatattattaagtgtctcaatttttattttcacaagttcttttatgacttgattctcattatctaaagcaaaattctggcatgtgattgccacctaaatccctgggtgtaccatacgtgggcaaattctatgctcaactatagtatttacaaagaggtagtggctcaatctgtaatactggctaagtcatttcccacccctgtaggagatggggtgactgcaatggaagcagacttctgtttttccatgtgaaaagtgaagaggaaaaaaatatctgtaattttcatatcccaactgaatgttgtagggatttgatgagctatttatgcaatcttaaaatcagggaattctctcaggattggttatctcttttgggaagaggctactggcaagaacactttcaggtgattcaaagagtctgaatagtaagattgttcttgtagcacaactactatatggtgataccactgactcaatgtcagtgagacccacgttttaagttatttcgcccaggagttcagatgcattagtatcaagccccgtgctctctcttggccccactccatttaaccctaaattagaatccttgactatgaaatagagtttttctctattccaagacatttattcattgagcaaatatttattaagtactatgtgcaaagtattatatcaggccatctgatttatatgaaaactgaatctctaatgttaaccttattaaacctatgttctaaccgagtaagccagccaaacaagacacaaaatcagaactttagatttgaaaggagtcccacactttacaggtgaaggcatttaggcctagacagtgtagtgattttgtaccacccaacacatcaaatttgtatcaagagccagaagcagagttcaaagctgctggtcatcagtcgaagatgtcttccatccctatatgccccttcatcaagtttttctctgaatctagacagtcatttctgacatttttctcttactctctttcttctttggcactgatagttcctttagttcagttaacaatgacatagctttaccaggttcagcagtgccacatccctatgccttgtttgcagcgagattgtcacattggtgttgagggaatgtaaggaaattctgcttagaggattattttgaccttgtcctaatgatatcaaaccacattgatttttcattagccagtgagagtcactatttggtcactatttgggtggtccctagccaagggaacatttgtgaaagctatgagttgccagtgttacagaaacccattacatctgtggttaaaatcctgggtgggtgcgggggggcggcagagaaaggggagcaaaaatatacaaaaggaaagggaagagaaccccagagaaaggagtatagatgactttacttttacctagacttttaataaaactcacaaatagctcctattcacatgtaaacatatataataattttatataaaatatatagtattttatatactatcatatagcattttatattttatatattttataattatattttatatattttatataaatatatagtattttatgtattcgttgtttcatataaaaataacttttcccattttacaaggatagaaattaagatacaggtattttgtattatatttcaaggccacaaataattttgaaaggtttgttacttttgttatgagggacacagagctcctaagatatgttatcacagcctttaggctagcaacactcttgcattacacaatctcctattactaaacttaaattttcttcaaaatgtggagaaacaaagctcattcagattaaattagagtctgggaaagtaaactccggattcttctctaatgtttcttctcctcatcgtgcttctcccccaacccagctatttcttgtgtttctcatcttccattttgatatcccattcaacattagagtcaccaaagcaaggaggttgttggaattcatcatattcattcacttcttggatattacttctattgtagtacctgagtttagattaggaaaactaagaatgagtctttagattagttgatagagaagagtttctgttaatatacattatagtctgaggtactctataataatccatagcagcatgccttttacctcctcgtgatctgtttgcttcttttgttccctcttaatgagagctggagacatctttaatgtaaagccatagatgagcacatgatttgatgacaagaagctactgcacacacagtttagatatcaaggcaaatgaagagcaagacttcatatcgctttaacaggttaaattagtcatcttaagctgttaatacatcaggctactgggcagaaaacagcagcagtgtggtagcagagcttcagaagtagataatcctaaattcaaatcccaaatctgccatttaccagctgtgtgacctttgttaatttacttttcgtctctgaacttccctgatccttacttctctcatctgtaatatggagatgataatagttgctgcagagaaggagtggcataatacagcttaggtaatgtgacatatgtgactgcaggttcaagaatttgtgcaccttctggccccagcaggcttaatatcagcactatagttagtccctactttcttacaagcatgtgattataagaaaagcccctctggttcaggcttatggtcctttcagttcagcattcattttctgatcacagggacaggaaactgttatataagacacaattgtccttgttgctaacttaaagaattagagttattttcctccagatagcctagtttctctgaataacccactatggacttatccatgaatttagctaaacctttgtgatactatttatgtcatcgacctttaatgaattttataagttgattgcctactgtgtaaagtagttctttagtttgtcataaattgtttcttttgaaaagtagtaagatgacttccagttcacgtatactagaatttgaaaaagaaatccatagtcagtttcccagaccttttgtttctttatagacatttaccatatccttgcctggattttatcattataaatagaaatcttcatcttatgtcatgattattttaattaatactgaacgttctcctattctttttatttatttattttttgaagtacttcatccagaaagtatcccacccatgagttgccgttaccttttactagagctgatcgtaatttaactctccccttcctctatcaaaattacactctatgctctgggctcaaaacagaatgatcttagtgtgactgcaattgtatttaagccaaagttcagcttagaaacagctggcaaaatgttcaacaaactggaccatagaggaagaatcataacaaaaagatgtgattccgtttgtagcaaagggagaaacttgtcttaaggaaaagctagagactgaagtttttgctcattttggatatcctaaagaagaagtagaaggcgatgttttctgagccaatttgttccactaaaagtgaccagaatcaagtctaggttgggctggctgccctaggttgcagttagaggttggggctactgttttgacaatggcagcagaaatctgtgaccaaaaaaagcctaaaactgcttgcctctgtgctagcatcgctagcatgaagtaagatttgaactttaaatgactcattatgagtgggtggcaacctactgtggagttagtctatgaacccaaggtcagcatcccggtgagaaatcccttcaggtttgagtgagcgatacacccagtcacactgagatgggagatccttgtcctcttcagctttgtcagagcattccctgctttgtttccaatcctatttctgaggatatttggcacactgcttggctcacacttggcaccactgtcttcagaaaataaatgtcttacatttgtacagtgctttatagaacactttcacatagattgtctcagttgatcctcacaactctatggtaactgttcatgttcccattttatggatgaggaaaactgattgaattacttgtgcaaatggtgttagtaagttgtagagcagggactggccttatgatactaagtctatgtcctttccatgtcaccgccacaaagatagccaggtcatttctggacatcttcctgaaaatataccttgtttcattttcccctgaatgtactgcattatacttgcttgtactgaagttgccctgacctcttgtggatgacagcaagcctcatgagatcatcctgcagacttcgccttttaataccccgaatactaataacacaatgttctacaacttccatatcatgtggagatgttccgtaagcctagcaccaaccttgcatctggacattcagtctcagaagaggtcatttatcccaaacttttcttctttttgtaaactttccatattaaaatcgtccttccactccttaatttaaatgtgcttcaatattattttaacaaactcagtagcatctgtaccttacatctttctgtacccttccctcccttgtgagggaagaatccctgaatgatcctagtaagttctgaaaagccttagcagggtagataatgggtaaagatcattgtatttcagctccctgatccattacacccctgcctttcaccagcatgcagagcgttgtgtttttttctaacagaataaattaaatatgaaagagaaggactaatgtaattcaaataaacatgttaatgaccctatttttccatttggtaactagaccggatgtggtggaatgccagttttttactgagcctgtaatttaaaactttcaacaaggacactttttttcccttttatttccatcctccattcccacccgcttttattcttacagacactccttactgtccaattagttttggaacatgaaaactgtcctcactgatgcctggagccatgggggacctgggatggtttctctctgtggaatggcttgtaagaatccagttttactggtgatgaccctgccagagctctgtgctgttgaagggtgtggggaaggaggtgactggtgcatcctgcacctcctctgcacccccactttgtgtatttttgatattttgcatgtacatgtttgctgttctaggcagcacttcagcattcagatttgggaatagaagagctctcagtttgcttttaaccctgtaagtagccatccatcccagctacattttttatgagtcaaagccatgttttaagagcttgttatcatccaaactaaaaccctcactaactcgatgtgtccctggatgactccctagtttatttcttcccttccctccactaagtcagttgtctccctatgcaccccaggagtagccattttccacagcggccaccacctctcctccagaaaatgggcggctcaaaatggagcccttcctctcctccggacctcaaatctgccacctgtctgctccattcatcattagttagctatagagcctgatttttctccaaactgtatgtatttaatccctgatttcttcctcacccccacgatgtgacatcctttcagcattttacctgctggaaccagcgctctcttgtttcttttactgtggtcacttgctagagtttgaaggaaaactttttgatgtgaacacatttcagtttttttccaatttacactggagagaggaatgaaggggagagggggctctggccctgttacttcctgtttgtttttgttctggagaatgcagaccatctgtgtctctcagaagctattcttctacagccaccgtgctgaggctgatatttaatttcttagtttttccctcgtttctctctaatgtccttttcctcttccaaaaactcctaagcccctcattaaatctttcttcctgaattttcttatcttaatagtacctctggatacggttctgtccccattaaggccagaatttcaaattaagtaaatgataattggagagagaaaacaggagagaagggaacaaggaatcagtaagcaaacagaaaaaaaaaaagtgggttgactttttaaacatggagttcgctgattctcagagccacttcccatgtcctggcatccattgttcagctgatgtctcacctgttagatggaccttgtctttctcagaagaaacatctgctggatgttgggtctctctctgagttgcctgagaaggtccctccctaatttatttttcctgccacccagacttcgataaaggctatactttctcatgataatcaagatggttattttctagaactagtagagatattctccctcttctgagagctgcctgatgaatcccaacatatagtcaccctatataaaagtcctattttctttctgtttcttttacatgcaatttcactaaacaaagtctctaaacaactaggtcctctttcagtagataattctataacttatgaaatttcaagtgtttcataagaagcatctttctgaggcacatcttcatttcagatgtcattgcagtttaggacacaatatttccctcatttgtgttttttaaaaaacatagctttgatttttttttattcttaaggtcagaattaaaaagctaaatgaattccaggcttcaaactcccagaattatagctggttcaagcctaaaatgtgctatatcaactgtctacgggggaagtgccgagtagttgtggccttcgtggagtgttttttggagctctcgcctgtcccccacccccttccttcagctgcttctgtttgttcctgctgtagtgccttcagccatgaacataccgtttaatcagtggtgtattaaaatggacctgtacagtcagcaatagctaggccaaaatcgattggctatttttaaaaggaaaaaaggaagatagaaaattgctcttttaatctaggtaaatcaaatcgtgcctgcttgctttccacctgtagctaagtgtaggcaagagcattctgattgatgacagtgtttctttgtgcttctttattcatgcttatccacttggggtaaaagcaccagggtatcttcagaacggagttttcacattcacgtcagaaagcttgtgctctttttctctcagaaaaaaaaaaaaaaaaaaaaaaaaaaaagtcttccctttttccccctcttagaagatttgaataaaagcagagtacgttcaaccttttctgcctttttggttttttcctgccatgaaatcatatctgactgtgacatcacagtgtgttgctttgggcagctttgtgatgtatgaaggcgaggaccttaattgggttaacagagcacaccaggagcggacggcggacgagcgctgctctcccactaggcagttctttgctccaggcagtgtgagagaatcagagaccagctagagaggagctccttctcccggggatttttaactctgaggctttgtcttcttttagtgtattactaaccaatgaaagtaatttttaaaagaaaaagtatataaatgtgctttgtttttaaactgcaaaaaattgggggtgggggtggaatgtgctggcaggtttgttctgtagcattgatttgtgaccaacaaaggaaatgtctacttgtgagacacaaatcaatgcaaccagactgcgaaagtgcaaacagagatgtgagaaaattattcaatcgttagtcttctatggaatttaaaaacattgaatctttcgattgttccaatacaaaaaaaaaaatcactagaagaaaggaagggagggtatgaggacttgttctaatttcgtcaaaggttttctctcgtgattatggaaaggtccggcaaagctataagattcctaaacattagcaatgttgtgaatgattttcagaactcatcaaccatgtcctcagatgctgtcaacagcaaagttgtggaaaactggtagaagacaagtttatgcctgaacttctgctttagtctgcagtaaccttggctgctgtaaactgaagtttcttgcaaattctctgtatccagaaataatccataacaagcaaactcagtacttacatagtattttttatcatataagcatgctacaaaaattaacaaatagattacatgggtaaaaacgtaactctagaaagctaaagaagtttattttgtaaaatttcatcagttcaaataaactgggagacagacgactagaatgagctgaaaacgtgatcatggaatatttccatgtactttgaactgagatttctaagttttaacagatagagtttcttcagcactaacttcaaaataaataagaattttcagtaacttatcagatgtgtgtatgttaaagtagttaaagatgtttcccccccctcatataggttacatttggtttcccccatccttcctcccaacagttttaaggttattagtttgcttagaaatcctattttcagaggtaataaaaaggcaaatttcgatacaatccctatcctatcacagattgcgaattattctgacttctccttttggagaagaggaaaaaagatgatcagatgttacttctctgaacactgaaaattaatgtaaataacttcacagtttttaatgttttcccagtgtctagtcaggccagagttcccattagcagtccagggaagttttctaacttgactgtatatttttgcctccatcactatgatgaagtcagttaccaagactctctcaccttatcctaaaaatgtgctatttctttacttcccaattgtcattatgttagttacattgctggaggaaatcaagggagtgaaatataatggatcagagacctatcaagtaaagtaatcaagaatggatttctggacaaccctgtttaaaataagaagccttgcaataaaagtgcataaatgtttcactctgtgttacacaataatacctcaaaatccactttctggtagttcagatctctgagttacaaccctgagcaaagaagtaactgaagaccttcaagtgtccaaatgagtttcccccaaatcttctaccaaaccctgcattcaagcagtattgtctctacagttcttatttatttgattttctaatccaaagcacattagaaaatacatttagcagagaggatttagaggcgatgggtctgaaaaactgggacagtgacgccagttggctatggcagtggctagtgggctatagctcagtctgtggccgttaggctgagccaagggatgaggccagttctcaccacaagtaagaaaagtgtattcctgtaaaacaggaacaatgaatagtcacaaggatgaccctgtatcatagaaaaaaattaaattacatcaacatactgtgtttaagaaaacaaagatatgtaaaagttttctatgaaaaacatgtgtagaatatattttactgcttaaaaaggcaagtttatgtcattaaaaaacattttaaaatatatggaacattttattcctcaatatagcttgcttttttatatcctttttcagtttgaaaaaatatagggattgttttgtagtagtgactctacaaacctgtctagccaaaactactcagtacaaacaccttagaaggagtacaaacaccttagaaggaaggatgtttattcttgaatattttaagtccaggtctcttaaaataaagatgttctttttcattgatcttagttatataatgtatgttgtcatctcgagtaaggcgcagttgctcatatttagctggtttactttgtaatgcgtcattataagtgaccaaaaacatggtacaggaagttgtttgtgtgttttttcattgcttatgcaacttccaagcagaaaatgttcttgagaccagatggtaaagaacagtcaattgcaagttctattctccagatgtattgatgtttcatgtcttcctgaagccagttcaaacacacttgtaaattcaagtcttaattttagtaactctttcacttctgctagatcctatttcaaatgataaagaattaggctagaatatttaataacaggatctctgaagcctgctgtactatagagtggcaatgccatggtcatataattcagtcggataaaagttcattacatgtgcttttggacgtatttggtcactgtgctacaatgacagctaagtgtttacagtaccaaacgtcttttcaactttatcctttccaaaagtgcactttgttaagacaattttaaaaaataacatttacccagtgtttctacttggcatgtagggtttttttttttaatctgctcagcaatttggaagtttgcttggaacacagatgagttaagataaaaagctgttttttaaaaaaaaatgcctctagtaagtaaaaatgaagatactatatctgaatgaatgtgaaaagttgtccctttgtatatttttaaagcttcctaaactatccccagttctcagccaaatgcagcctacccagattgtctttaggaaagtagcaattcacagagatttgcagttagccatgtatcaaactacactctctttagtccctgcttacagctccaccattttagaatatggtgagatatgccagagccctaccatctgtttaatgggctaattatgtttaccacatgcctacttcacaggaataccatgagtgaggttgccaaacatcatacaaatatatatgtttgtatatattgatatataaatatacacataaataaaattgtatacatatataaaagcattcagcatttctgagtttcattccatcttttactctcaagatatatcatggcccatcccttaaacccagccaggtgttgtcagagtttgtgaagctgttgatgataagaccgtcagactgagagggatcctctaactgagagatttggaggaagtgaaactcaaattgtatacacattcctatgtcttcgccatttagctatgccccatgttctctctactaaaatgtagacattttagcttcataattaatgcaattaaactttatgacactgtatgttgctatatccaatgactaaacttcttttaagaaacagaggatctcttctcctttattggaaaaaaaaagtcagactgttttaacacaattcctcccgtacatggctacaacttttctcttacataccacagcttctatattgggcttgttcttaaagctaggattttttttttcctcctatgaggacactgcaacccttgaaagtttttctctggtattctctgagtgcttcctagatacctggtttcagtgactccagttatcacaaggactaattttcacttgctatccatgaaaattttcgctgggtcaaactaagttgggtcaaactaagctgcttcttggaaatggggcttatgctagtcgtgagttgtgtccagagggaattctgagcagtaaaaggaggcaaactgagggcattctaggtgaagggaattaaaccagcagagaatcagggcacagatggaaaagagcgagtcatgggtaaccagagtgcctagtcaggatatgatataagctccgggtattgggttttctgtgtagctcctttgtttatgtaaagctagctcggcaggctctgggccttcttggctttgaggatgcactgacctgagagctatggggaaaaatagccacgtctgtacaccagactataaagccaatatgtaccattctctttgaaaatgaaagacaataacatatgaaactattattgatataagcttttatttagtcttttctaagataccagggtatttttatgacctgttttcttcccctcggcgttaggatgttttcttatactgcttcaactgaagtaaattattcaaacagagctgttttgttttatttgtttgtttttgtttttgcagctttatgcttaccagggacttcataaacaagttgaaagagaaaaaatagccaagacataaatatagaaataacccaatcacataagctttcatgagcatgggtgagggccttgtgggaaggatgaggaaaaatctttattagtaccagaatgatcgtgattaccttaggcataagtctgatttgagaagagacactgatatacaaagaaaggaaggattattcccctatgatttgtccatgtgtacaaggaaaaatagcttcagtatttactatttgacttcttgagtccagaaacctaatactcactgcaaactgcataggcacggagcaggagaaagcaagtatttaccaaaacaagaggaaagaggaattactctttcatctcttcttactttagaatcatcaaatgttattactggaaagaatcttaaaaaccatctaatctaacactcccacattatatatgagaaaaatgagactcgagagaagtttcatgacttgcccaaggtcacacaacagattacaaacgtggctggggacccacatatgataaataggtgcccttcatttcttcagtttctccataatcattttagagaattatttgacttatcccaccaatgttgttttgtatatctggattatcatctggcttctcagttaatttttttgaagtgaagtttgctttataataactgccagattctatagctgattctaaaaattaaaatgtgttctcagacatatcctgagtgttgtacaaatatggagacgctcactagatcaacatgtatgcctccttattttatatgaatcctataatacctataaacgtggcctgatcatattagactcttgaagtttctagagttccagatatttgttggagcatataaataggtgagagcagatttacgcatttacccactctgagtccctgagacgttcctgaactgctgtgcctttgtaagtcagttattcccactgctatcgatatcaccagttccaattattaccaatatggcccattactacagactgatttcttactaggttcaaaaccagctgtacttggtgttttactgatattttgttcagtgttagaggagaaagaacatggtgagagtctggcatagcccagctcccttctgtgaagaaagagtccatcactgacaatagacattcaataagtggttatttaaagaggtcgaaaaaagcatccaccatttctctatttcaaaataatcaatcatttaaaaatattaactacaagcttctgatgcaatgttgtgtggtttgttgtgccacatatggttatgatgatctacacgtcagctacaatccagaaatactctcattgttacaatgcaaaataatataatcatccacttttacattttaaatgtgtctggcccaccaagtccttgcttaggtgccagacacaccactgtgaaggaactgtctgacatagtatcctgaaatttcgggtaagtataatcatctcccagatgcatagaataagcctggtttttgaggcaaagagaagaggcaaacctcctgcccttccagaagtcagaaccattcagcaatatattcacagtagctaggggggaaagcctttgtgaagaaaactgttgtgtctcatggctgtttttattaaaacatttagtccaccagctttccaactctacgaacaatttaattcacaaagcacatgaaataagcagaagaatctagtcccaacagccatgttccacctctgtgatcctcgtcgtgagttaggatgatttagtcgtcaagatccctgctgttctgtgcttggatatttgtgaggaaaacctagaattcatcccctttagaagccatgtccatatggcatgcagcaaagaccattagagaacagtagtaggagttttgttatcaaatccagccagatttgcagataggaatactgagaaattagtatttttccttcctcttcttctctcttttcctttttagcctttttctttctcctgtttgcttcttcaattcaatactcctttgtttatggatttggagagtactccaaaagcaaataagccaatcaaatcctgtttggagggagaacagccattttgacatataaccatctcatcactcctttttatatgcctaaacaattgaagagcatgtagcatagccaggtgctggtcctcaaagtgggtgtgccctaaaacattctttggtttgaactagtctagtccactgtttcatgttactgaacaatcaaaagagaaaagaaagtttttcttctctggttctagaccaaatgactggcaggatgtgattgccatctgtaattttctgcgaagtccttccccagtccaatttacatgatatgtacagctacttcactctgagaatgcacactcaaaaaatacagcctttaagtgatttttcctagcatgggcaaggtgaagcagtgaggaaatggacgtatatatgttatacatttatattattattccccataaacttttaaacttcctatccagcatttgtatttgttctcaaacaaattggtagtttaaagaaaatcctacctttgtgatttttcaaaaatcatttttcagcctctcctattatttttttttatttcagtagccaccttaatgggtagctgagtggggatcaagtataaaaagacctcatcatgtattacaagccagagagtgtactcatgggaaaaatgtaagtcctcagatggaaagtcatctccgtcaaagaaagtggctcgggcaaaagtgcctgacattacatagtctgcatggtggaacactgcagccatgttttcagttgcctttcactctctggaattttatgaaatgatctcggccaagaacctttggaatatcactctctggtcaaacaaaaaagaggacaaaaaaaatcctttgaaagttgaagctagttggtacaagctagcagacaatccagtgaaattttcaccccactctgttttgggggtttggggtttttatgcagtataagagtgttagagaaggtgtctgtctggtatggattgggatactttcaaatactttaaagaagaattcttgttttctacagtttattaaactagctcagctaagtatattggttatcagatcccatgatgcatgattattcaatatattttaaaacacaaaaaaattcaattgtgctgtcccctttctccttctgtctcctccctgtctgtctcactgtgctgtgaagcattgggagtagtgtgtgtgtgtgtgtgtgtgtgtgtgtgtgtgtgtctgggaggtagacagattccctacctggaaatggcttgctattattagacgttcagttaccaggggttatgtaagacaattgaagctctgttttttaacagagacatgattcatgctgcttgtagtaacagtaaccacctccaaacgagacagaaaccagacacagacaaaggctggagaaatcaatgccgactcggtacagccattctcctgataccctctgcctttcaatcagagcacttaggttatcaggagaggaggctcctgctaattctggatcctttttgtctcttggggctgccaggtgaaatcatgtgggctggagctgtgtacaggagaaaacgggtcctcaggagcagtgacgtctgacctccttccctagggtcccccagtgtttcagacacacctggaggaacagtgattgtcacctgtgttgtggctcaggattcactgtggcttctactcagaaaggttggaacttgagcatttggctcacccactcaagtaactttcctcaagtgattctctgcagcgtgctgggagaggagaggatggagtgggatttgagctgctgccagtgctttattatagcttctcctaaaacctgaatggaagtggactggctgtcagttcccacacacattcgggaccctttcctaaatcttccagacaacattgattcagtactccacactatacaaagcacttccacatggatcagcttattttagcctcacaactttataagataggcaaagcatacattattgtcaataccattttacaagagagagattttacagcttacaagtattatgccattcattgattccttgctcatgactttataagtgagaacaataagactcacaaaagttagtgacttggccatggtcacacggctggttcttaccagatccaggaagacaaggcagatcttctgattctccatctagtgctctgccccagatttgctacaaagcttgttgacaaccatggcattttttggggaaaaaaagcattttctgctgaaaatcttggttttagattaagttctactactcattagctagcccgcttaaactgccctttccttcctcttcaccccatccacctcaatctcctcatctatgcaactcatgatagggagaactcatttttagagtgttcatgaaagtaccacataatctttaacatgtctaggtcaatatatataaagcattgccaatagtatctccctgcccccaccaagagtgaaatccagcaaagagatccagagatctcaggcttcacccagaacataaaagtaaactatttatttttactacaaaaagaagaaactcagatactttattgcagaaactgcccatggctctcagaaaatagcagtcttgccccggtggcctgttacacacccaataggcaggccacccttcattttcactctcacatgtgtaaattgcccagaaagacaattcttaagtattgacatgacaggaaaacatctaggccatttagcttcacccacccaataatctcctgcaataaaaattccaatttaaaaaatacttattattgattactactaataaccaacactctgatacactgttacgaattttaactgaagacggacacagaattttatatttatgaaattttaccattatccttctatttcacatgttaaataatacaagctatacctattttaaggtaaacacaagtaaacattcttatttataaaatagctttttattaaattttttgtttgtataccgctttatatccaggaaggtagcaaaatactccacaggttatactctaataaaatgcactttctcttctgctaaaatatgaaattgctgcagttttaagaaagaaagctatacttttctctctcacataataaaactccctgactaagcatcaagagaccaaacttctagtcgtaggcccactaaaaattcactgttagggaacctgctgagtcccaacttcagataacatctaatctgaaaaactcagggccccttaacatctagttattacacactagcccgagacaacctgccctgcgctgttgtatgttgtgtcaataaaagagctttatgggaaagatggaattcattatttggggttttatgttgtgccagtcgttgccaagctgccttgaattcaccaatgtattgtgtctccagactgattcaaagagatagaatttggaatgtgactagaaggcagtagcagattctgtaaatagttgctacacattctgtataccaggcacaatagcacacagtggaacctcagacaatacttaccctgacttccttaagtaggaaaatatcctttttcttttcatcaagttaccatgatttaatgattatgaatggtaattttaccattggtatattccagtgattcctttcatggatcacttgatgttcctagattattttaatcttatcgccatttggtgttaactaatgcaaattcttactttcacctaagaacggagctgcctttgctcttctgtatctagcctttatccacatccttagacacacatggtatcattttcagggcaatggcagtgatggcgggtagtgtttcttcccaatattgtgatggaacatttcacctgggctgttagcatcttaaactattccaatagctacagaaattgggttttaaaccatcatgtcttaatgccatccatttctgtttatattaaccgatgacatggttataacatcctactgtgctcaaaaagctggggtctctgtagtgtataaaacaaggttcctacccaagaggatgtacaccctcgctaataatatagcaaacaggcagtaaaccataaccatttattgaagtacttaaaaagtggcagaaaacattatgggctaaagcagtcttcacaagggaaaatttcataaaggatacatttttatatatggaccctgaaggagaaaaaagtcctatataattttttgaaaggtgataaaggtattccaagcagccaaactggtatatacagtagctcagagatagaaatgtgcttagtctttctgacaccctataagttaaccagtttagaccatgtggagtattaatggaaaggaaatctgagaggactcatttgatagggagtcagtgaatttccgagcccaggcttaagagtttggaaccaggggaatcccttaaagcatcttttcccgaagcatattctgaggttaaataagtgttccattaaaaagggggatgggggagtctgtaatccggtaagcctggacaaagattaggcttccagcaccttaatatcctgtgtacacttgcgagtttgaaaatagaatatatagttttcagtgtttcctaaacttacttgactgaggaactttttttgagatgcatcttgaagttccagtatgaaacacactttaagatacaccatctgaaaagatttttgaagggcaggagttgaatgcgggacaaaaaaaaaaaaggtatgtggtgatgattaatctagtactattagaaattgatatgctatcagctacagagaaagtatccctgatgaaaccaaaggaagataaagagaagtagagagaataaccttcaagatacgaagggaacatgggaaaagatatatcctgaggaaataaaataatgaaaattcagagatattagaggagatgagagctaataagcttaccacactgcatggtgtagatccttttattaaactaggatgctagctcatcaactgaaaaagagaatgggacttcataaaggagaacaaactaagaaaaactgccataggttgtacctggaaacagtgggcaggagcataggtccaggtagcatgcatgtgtagccttttgttctgagagtgggagcaaatggagaatggtgatacagattcacagttgatgaatgtaaaaggaggcactgcacatagaaagttagaaaaggaaggaaatctgcatggttactgaggacagtgttgaaatggttgatcatggggcaagatcaaactggacaaatacatctggtaaggccaactggggcctactaatgaaccagctgaaaacaataggttccttgggcttctgggaaagtgagttcaatagctgggtgtggaacatctgatgtcaaatgtgaggcctcaaaagagtaatttagaaggagtatgagagctaagaaaaggggtgataaagtctgttgaaaagaagtgttaatgagtttttggattaaattattaatacagggagggaaaacataaatcaagtgtagaaggttttgagaaatttcaagaaatattcaagaagacatgagagagccatgaagaagaatctagcctaagccaatggtggggatcacaaatgaagaggagtggaatgaaggcagatcagtggtttggtgattgtgagcctggtataggttaagctctagaacatgtggttagaacctggcccttaactctgctttgctaccctctgccttcatgactgatgaccaataactgtacctttcctgagtatcagtttcacctccttcgtctataaaatgggaatataattcccaacttcaaagagtaattgtaagaaaataaagttatctgtgaaaaggctcaatgcctgccacacggtaagcatttagtcagtaatagccaaagttactattgaagtgatgggagcaggaagagggaaatgatgttcactttgggaacagtgacagagtgtgttatctggagtaatgccactgtgatgtttctctgtacctttttttccatttaccacaaactataatggttaattcagaacacatactcactgtaagaggtaaggtataggaaactctgataataccaaataaaatgctgtgtcataaatcatgctcatgttagaattctcattacaaagtttaaaacgatcttattaacatgacctgtggcaggctttctggataagaaggttccagtatccggtgacataatagaggggttcccatcaccaggccagattcattaataccagaaattcatgattgtgtgtgtgggtgtgtgggtgtgtgtgtttacatgtactctgatccaaaagatctcttattttaaacaagaatcaactgtatctgataatgctaacgctcatggcatgggatgtgcaacttatattaacagagtttatgaactgtcaaagaggaatcaagaggtctctatggagaaaattaacatagatttaatgtgacaaacagtgggattgtgattccaccttgtgttggcagggccatcccaggggtcttcaagccatcagaggtgtttcttatggacatgggtattaactagtggttaattaaggaactaaaacctaaaaagtaaaatagttatcacagcatcagtaagctgacgatggtgttcctgattagtttatctggccgtgatgtctttggtgccttattcattaaatggttttctcaccactttccagagaggtggggctggtgacgtagacttgggaatttgtttcgggtaattagctaaaaagttaaaagtcaaatagacttccttaacatgtttaatggtttaacaggttgatgagctacttaattcccacatcttccttctcaggggactattagagttttaagggaccttaaaaatcataaaaccaacctcctctttttgcagatagaaaagctgagccacctagaggttaaatgtctcatcggaggtcatcagctagtcctgattttgctttctcttttcttatcttacactttctaactcttttttttctaacattgtattccccacaatgacctctctgctaaatatttcttagatgtatcctttttatgaaatttgctgtgcctcaaattatgatagtgggcctttgccaattagtaacccgtccccactaactcaccactacatttggggcaaagaaacgagggaagtggaacaattttaaatttactatgatctttgagacagctttatcttcacctgggaattgctgttagacaattaaggttagtaaagctcattgaatttctcagagggaaggtgttatttgaattattaccagataattattgttaaaaataacaataatgtaaaaaaataggaactttacatgttagagacattatcattttgaatttccagagagaggggaaaacccttggggatctaaaaacaattttttgacagtgtgctctatgctaagaactccttgaattctgtgtaatgcctgatgacctgacaaactggcctagaatcagaagccagtcggctggctgtgtgaactgttagccaagttatttggcttgaactgctccttcaaaaacaaccctagtagaaaggagagtgtcagaaataagacctgtggtcccagaccagtagcatcagcatcacctgggagcttctcagaaatgcaggatcacaagctccaccccagacatgctgaatcagaagccctgggtgattcgtttgttcattagagtttgagaagactgttagaggacattctcatctgcaattagaaaggaggagggaagggactatacttattggcagtttctgaaatagttccttctcctggagtctgtgctcccagatctttccagtggctctgaaccatcgtggaaataagcatcttccttgtactgtgatcacagcgggaactagaaatgtgtcccgtgtccatgctgcattggaacagttgttatatagtgaaaagagtacagatttagactcagagagatctgggtttggattctggcctcactatccagtagctttctaaacttcgacctgttacgtaagcccattaagtctcacttttccttatctgtaaaatgggtatactaaaacatacaccatagcattgctatgagggttaaacaagaacatactcatttataaaaatgcctggtgcagtccctgataaaatttagacatccaataaatgctagctgttattgttactattacctttcttgtaaactttaatcatgaaccccccatctataattttagaacgatgtggtgtgatttcctaggactgggacaggccatactcaaagtagacatctgcagaaagttccttacattgatatgtggcagtgtatttcataacagctctgctctctaagggcttccaagacagatctgcagaaacgccaacaatgaaacgggctgtagagaagtgacctactgtctgttcgcctctgacaccatcaagaaacttgccagctgggttccaagagcagattctttattacagtgatgatgtaagaagcagagacaacagctggattttcaggttctagggagaatttgtggcatcagcagcccctcaaaattatcttttgacttaaaaaccgagtacactggatatgaaagtcattaaaagagaataaatgtgaaaccccatgaagtcattctcaccgaatcttttttagagtgtaaccaccctttaagcaataaaacatgacacaccatgcagtggttctgattaatagacgctcaggtgtgtactaaggcaaaaggggaaagaagatggagctaggtgacactttgccaaaaatgaaagtaagattatagcagcaggatgtgggactgagaaagaaggatttaattaaaggacagacatactatggttgtattaattataaaatgcacaatgtaaatcagattttagatatatttaaaatgtacatttatataattacacaaaggatttgtaaatttgccagataatttttcactgcaatgtactattgatgagtgatttcctttatgattttaatgtagttgccagggggcaaaaggagaagtaagttctatctggtgaagtgtcaataatctgtccagccttatgatgggttagaaagaacaatgaagagctcttgagcccattttgctgtttgtgtggctgctggggtgatgctatttaatggatgtctcaatgcgtagcatggctccaccatactggccaaaaagagtttgattaatgctacctaccaaggttttcctctggtgagtaacagtgagtcaagcgctcacctgggagatgcagatgaggtcttgtagtattggagctaacatttaagagctgagcttttctggccaagtaataattactgagattccctggaaaagtctgttttcctcacctaggtaaacactattatccccacagcatgttttgttgggcttttcatctttgggtgagagaaaatgattctgtttgaggataaggatagagaagagaaacaactaatgtttcctctactacaagagaagaacaaggcaagaaaatttgaacagactcagaggcaattgtctatgcatttctacaagtaaattagtaatataaggaaagaaaaacaagtaaacatttaaacaaacctagagaatgagtactaggctaagctaggtggaaaaagaagtgttaatgtggcataatagcagattgccaatagtttgtttctacaaagtaatgaatttaaccacggaattactgcatgttttcaccaagaactccagctgaacacacagcttttccaaagcatgagaaatttctttattcttattttcagcctgagtttatcaccccagtggtatttttaacattttatttgtttttaatttttgtgggtacatagtaggtgtatatatttctggggtacatgagatgttttgatataggcatgccgtgtgaaataatcccatcatggagaacggggcatatatcctcttaagcatttatcttttgtgttacaaacaatccaattaccctcttttagttattttaaaatgtacgattaagttattattgactatagtcactctgttgtgctatcaaatagtaggtcgtattcattctttctattttttgtacccattaaccatccgcacctcctccccagtggtgttgacagtattgtcataattatttctgctggtaatgttagaaaactttgcttccttgttttttaaatccaccctcattttttagacaacatttaactataaaacatatttattagttcggtttgttgaagcaaataaatgaagcaaatttgttatattttggaacacaatatatttttgcaggttacacaccccaacctccctctctctggtcttgtcattactgatgatctgttgggcctattggtgccaagtaagcactgataaatattagtctgtggccttttatgtctgttatccttgcccagccactaacaaggatgcgaccttgagcaagtcagttcccttcatctcttcgtctgaaaaatgagggggttgaagcagatgagcttttaggtcttttcaatttagtccccgtttctatgactcaaggcaagagggtttattctttttaaattcagttcagcagattatcagcctagtgcaaacttaacgtgcaagaagtcatggcccactatagggtactcagagtaaaaattgtctcagctttcaaagggcttatgaagaaggaagacaaattacacaaataaccattctaattggtagaatatgcaaagggagtagtacagaatgtgctaataatatttaagaagggcactctcctttgtgaaatgcttcataaatgaggtggcatttggatggcccttgaagaagctacatgtagacattgaaagaaaggaagaaataccatgaacatggtaggaaagagtaggactttgctggagcgtagaatggagtgtagagataagagtgagaaactagattgggctacattgtagcagctttgaataccaaactgagaagtttgaatttaatccaataagcaaggaggactgtaagcaaagaagtgatatgtttagaagggcactttagaaaaattaatgtaatgtttgtgtgaaggatggacaagaggtaaagaaaaactggaaaagtgaaaccagtcaggagcttttcatagatgtcctcacagtaggtagcaaagggagaaataggggctggtatagaaaacaggtattgattcaggaatcacaatcagagtagaatctacaggattgggtagctaattggatataggaagaaaaaaaaaacggaagaattgaagatgactccccagctgtaggcccacgtaactggatgaagagaataccaatggcaggaaatgggacgtctagagaaggaacagattttaaaggaaagacaatgaattaagttctaaactttctgaattagaaaagcctgtgtagtatttgatggcgatgtgaacttctcaaagttagagaccctgttgtattcatccaggtgcctcatagatgctatataaacactgaatgaatggacaaaggaacgaatgaaccaataaccagctgttatttagaatgtgggtgtgcagctctgtagaaaagctagaactaaagatagcaatgtggatgctctccatggagaagtgattgttgaggtcagggaggactggggtagacaaagcctgaggagaggatctagaggaatgtctacatttagagaacagaagaaagaaaataagccagtgaagaaggcagaatagcagactgaggtataggggaaaaaatagggtaattcggtgtcctcagggttagagcctatggaagaaaatggagcctttgcagtgaaggacagagggaatgctcagaacatgcccagatcaatgggtgtcactagaatacattaagaactaagcaataaagagagagactgaaatgaaatcaagaatatcagaaatgtggtaaaagtacacaatggaacactattcagccttcaaaaagaaggaaatcttgtcatttgcaagaacatggatgaatctagaggtcatccatgatatatggggaaaaaataggcttttttttgtactagaaaagccaggcacagaaaaacaaataccacgtgacctcacttatatggggaatctataaaagcttaatttatagaagcaaaaattagaatggtggctgccagacgctgaggagacatcagtcaaaggacacaaaatttcggttagacaggaggaataactccagagatgtactgtacatcctcatgactatcgttaataagaatgtagtatatattgaaaattactgagagtaggttttacgtgttctcaccatgaaaaagtgataaatacatgaggtaattcttttttttttttttttttttttgagatggactcttgctctgttgccaggctggagtgcagtggtgcaatctcggctcactgcaacctccgcctcccgggttcaagcgattcccctgcctcagcctcctgagtagctgggactacaggcgtgcgccatcacgcctggctaatttttttgcattttagtagagacggggtttcactgtgttggctgggatggtctcgatctcctgacctcgtgatcctcacacctcggcctcccaaagtgctgggattacaggtgtgagccagcacacccagccggtaatgcatattttaattagtttgatttagccattccacaatgtatacatgtatcaaaacatgttttataccataaatatatacaatttttatgtgtgaataaaaaataaataaatataataaatgaaaaaaaaaagaaaaggatactagaagaatcaactgtgggaaggttgaaggacactgtttctacttccttcccccactgtcacccacaactcagcttctaagtcagaaccacaaaatcagctccgcccgcactgacagggtactgttgatgtcccaggctgcacaggcagttaggtgaaagcactgaaaatggagcctggacaacatcctctccattctcccttccgtacctcgccattctctggtgcaaagatgtagaaccaaacaaccaacctctcactcaagtcccaaagttctttcctatcaaaataaataattgccatcaccatcacctgttcatttaacaaccttatttttgttttttgtctgatctagatgcagccgctctctgctccctgccccaatgaacatctgcactaggcccaagccttggagtaatttacctgaagagtgacaccattgattttgaaactactgtgagtacattatgtctccaataaaaggcttcttagttcactttgtttaatacacacacacacacacagaaaattgtgaaagcaggcaaaattttagatggcttcatttcttggatcagcagggtaaccagactcagtcctgaggtgcccacagcggttctcaacttcccggctgcagtgcacaccatgtgcattatcattccctcctggccagatggctgtgctgagctgtatctgagcacaccttgcagggactggtgctgttctgcttggtcatctgtgcctctatgtacggtggtggcagcttctcctaatctgtttgcttctcatcatccttccgtgccactgttgaatctcatggtagcttgtcatttcttgccaccctggtcaaatctgtgaccagcagctttgcttggttttatttacctgttgtctgagctgcaacccatgctgttgtctccttgctgcccttcccttggagctctggcctccttccaccacatctctaagccacttgtatccagctcacctctgctctctggatgtatgggtctgtgtagttgatttagttcccgccatgcaaggcatttatgtaggagaagtagagaccttgcaaggaaaagtacagaaataatttggggtaggggatatgatacctatgggaaaatactgatgaaagtttgatatcaagtattcattaatcattgctgaaataacagatgaatatatgctattttccaatagaaaagccagtcatttgaattatttagaagttctgcatgcaaagtaacttaattacacattttaaaacaataactagttgttatattcacaagttttcctatatgttatgaggcaggtaatgggatggtgttttacagacttctatgttactggaaaacgctaaacctgggagactaacatccctcttaggcttcaggtaggatatttacattcatatttctatgtctttagctattctggtataaatcaaacctaaagggatgaagccagagttttgctttattttgtgttgcttttttacctttaatgcttccagtcaactgaatcatagttgatgggggctgctgtgtaggtgatagacaggcctgcctttcccggaggggaatgtgttctatagtactaataggactgagttactggggactaaagacatgacagaagatcaaacatagtttcttcagtccacacccacacaaggaacttacttgtatataccttcattcatccttaagttcaagtgcaaggaatacccgagaaattcccacatctggatagttttctgagtttttcttcatcacagagtaactatgctgatacagataacacagccttactatgatgcagatgggtttaaaagtttctatatcctttaagagggaaaagagttcttatcactcttaccttcctgtgctacagagaacccagatccagacctagaaatcaggagctgatgttgcctacagattacagagaagtccacaagtgagcatgtattcctgtcgtaggaagtatttcatctgtgcagaatgccagtgcctgcttttacttctcatgggccctagagaatggacagactgggttataatctttgcagtctttgctattcagaaacttggctttccaatgcataaaagagaaataataataataaaacagaaacttgctaggtgcaaaaatcaataaagaggataaaaaattaaaatgtg

SEQ ID NO: 226 - DNA, 25425 bp, Homo sapiens
gccgggtgctgagcaccggaggccccgccgaggccgggactcaggtaaagggctggagcttgcggggagggttccaaaggtgggcagcagcccctgctgcccagcgtcctagaggcaagaagtaactccgactcggagcagtaggagggggcggtggagcagcatggaaccgggcttttgtctggggtgtgtgccgggggcttcgagtgtccacggtgcgcccgcccctcgccgccccctttttgatggggtgcttctacaaagtgggcaagttttcccgggaatccgaaggcggcattttgtacggagttgaaagagagggagggggtcctgggggtggtacggtggccccccagagagctgcctctggactccagagagcttccagggttgctggtggaagagcagggagaggtgcatgtgatgcaggtgggcctccatttcccagaggaccgaaaggcctccaactgccttggtccggagcgcgagcaaccaggtgcccccggagggttgggaatggggcgccgcgggtactcctgacctacgtggagcgcagcgcgcagggccggcggattctgcacgttggcgccaggttcagcaccacccggcagccctgggcgagcgcgggagcccagccttcgccaccgccgcaggaggcaccggcaccgcgcccacctggaccctcagccagcacttgggaggacttggtgcttaatgccccatctttggttcgccctaggtaacctgctctggcttcagcagcgcccagaggctttccagagagctgataaccacgaacaaacttggctgtcaaaagcaaatcaatgctttaccttgttttctgggtgcctagtctatccaacacaaactatccccgaagtttagtcaggatttacgctaaatatattacttatatagtaagttattcgatataacatttttggtcaattttctaggctacagttttgatgtgttttttaaaaatcttgaattaactgaataacagttcatattgaaggtggattctcccattccctgcacccaggattttccgttgttccatcaaattctgtaaatcggtatgccctaacagtttcttatatttgagttggcttcagcttcgagaaattcttcaggcaggtttaggcagagggctgaggaagctagagaagattccgaagagaaaggatgattatttgttgcatgattatagcttcttttaaaacttctaataggaaaacccttccactttcctggaccaaatgcagagtaaagtcattttctattatctgttgcaataattaataataaatatgtaaatgcagaaaacatggttagtacccatatcattgccagaaaccagtcccgctctccctccaccatcaaaaaaaagtcctcgcaagtaggaattagataaaataatttaacctgcaattttgcaacaactcagactttcagcaccaccgaccccctaataacatccctactggtttcttccattttttgtgtaggcaagtggaataacaggtatccttcatatccataggaagagcattgggaggagccaaagatatggggaggtagatcaagacattaggaaatcttttctggcttctgactttgagtctgaaaaggtggtgtgaattggttggtgtctgaatctttatcaggacacattatggtggtctggggtggatctggccatgcaactcaagctagaggatgacaactacagagatgtggtcacattttcaagttttacttccttacctcaatctttcaaacccctaattaattaggtaataaaaattgtatatatttatgatgcacacaacacagtattttgaaacagtaatacattgtagaatggcccaaccaacataattaacctatatgtattacgtcacatttttatcttttgttttttttttttttttggtgtggtgagaacacttcaaatctaccatcttaacaattttcaaaattgtgactatagtgactatagtcactatgttgcacaatagatctcttaaacttattgctcctatctaactgaaattttgtatcctttgacaaacatctcttcaccccaaccctacctactggtaaccagggttctactctattctctgagttcaacaattttagattcaagtctcccttcccttcccttcccctcccttcccctcccttcccttcccttcccttcccttcccttcccttcccttcccttcccttcccttccctcctctcccctcccctcctctgccctcccctcttttccttccctcttttcttctctctcttctctctctctctttcttctcactgcagcctcgacttcaccaggctcaggtgatcctcgcacctcagcctcccgagtagctgggactacaagcgtgtgccaccacacccaggtaatttctgtgtttttgtagagatggggtttcgccatggttcccaagctggattacaggcatgagccactgtgcccagctgacttccctttttttttttttttttgagatggagtttcactcttttttttgagatggagttttgctgttgtcacccaggctggagtgcagtggctcaatcttggcttactgcaacctctgcctcccgggttcaagcagttcttctgcctcagcctcccgagtagctggcattacaggtgcgtgccaccatgcctggctaattttttgtatctttagtagagatggggtttcaccatgttggccaggctggtctcgaacttctgacctcaggtgatcaacccgcctcagcctcccaaagtgctgggattacaggcgtgagccaccacgcctgactgatttccttctttttcaagtctgaattagtctcctattgtgtgtgtgtgtgtgtgtgtgtatcacatttcttcatccattcatccacttatagacatttaggttgattccatatcttggctatggtgaataatgctgcaaggaacatggaagtgcagctatctcttcaatataatgctttcctttgggtatatagtgagattgctggatcatatggtagttccatttttaatttttctgaggaaccactgtattgttttccatcatggctttccaagatagtatcacttaatgacttcaattttaattaatgattgcaaaaatgtatgtattttgagctacttagccttttcttctggaggttcttggcagacaccaaagtaacccttatggatgatgagactgaactataacaaaacaccaagttcaaaaaaaagaacacatggtccctgcctccaaatgtttagtgagaaaaatagatttacaaatatctgcattacaagatagtataaatggagtcatagggtagaacatcaatagtgtgctactgaatgacaaaggaaaggagaggttcattcaaggctaagtgtgaagaaaagttgtggggtgggtgtagcaatttaggaagaggatttccttgatggaaaagaggcctgctggaacaagagaatagcacagagataaggaagtctagtgtgtttataggaagcaaagcagtttggagtagctgaaacctggaatttaagacagataaggctgggaggtgggatggggctagattatagagactatgacatgtcatgctaagaaattaaaatatgattgaacattattggtatatttacataaacagtatcaacatccttaactgtactttttgcctttaatttcagttttatgagtttccttctaaaataagtagttgattaaaatctcaatattcacttcctatcagtttctttcaatcagtaaaagaataatgtattcctaatatccttcaatgctttatctaaatccaacagtgttttacccccaaacctgcattcctatgatattaatagctcttagcttgattaaaacttccgatagaaaaacacttccactttcctggggcaatatgcagtgtatagtcattttctattctctgttgcaatcattaataataataattaatgtttattaaacatgttatgtcaagggagccacatagccttatgttatctagggaggcattattttgatcttagactgagaatttttacaaggtcacacaactaagtaaagggaccaaggagtctacccccagagtctgtgctttgaactattgtactatcatgtaacggggcatagtgtatgataattattgttaatattagatagaaactgggcctgattcctgtagcaggactgtttctctgttttttttttctttgcatcttaattttcatcatttggattaattttatcttacactttcagtgacgggacatattttaatgttttaatacacttttaaactactcatgggatctcgtatttttatgacccacccaaaagaaactcttaaactctgagaagagacaggatgtgggacgaaaaaaaatgttagcaacagtgatggcacaagatgtgaagaccaggcctctggaagaatgttgattaccaatattctcatgattcccaataaactccccaaatcaccagatctttttgcatttcagcatcccatatatttttctgtgtgtcttgatttttttattatgaaggtaatacagtaaacatactactttgtacatgacatactaaagtatgtatttagacaacagatcaaacatcacatgatcatgtataaattgtgcaaaacgtttgctaactgaaagaacacgtcagtgttattatcatagatttcttcaccagaacactattctcaggccaagctctggaggagagggttgtgtggagtagagagaagctgaaatgagagcctggcagtccagtgaccctggtaacagtgtgggacacagggagatgatgataccaatgtatctcagtgtctggccctcactctgcctaaatttaactgttacatctttatttttgtatttactttgttaaatatttggacctttccatcttttctcaggctctgagtggtttacagattctgctattttcacttttgagtttgagagtaggacttagaaatagatgactcttcaatggattggtgagtaaaggatcctgaaactgttctctcctttagcatgacgtctctcaacttcagtttcctcatgggtagattgagggattgaataagataagtggtggcaatcacaaatcttcacaaggtttacccggatgagacaggcatcataaatgagcaaagaagactgggggcagtggttgggtagtaggtgtgtggaggtatgggggatagcacaggtgaaactaaatgcaaggcaacgttagtcctgcgtcagggagatattagggagtagaaggacctggagagaaaatgcctcatccaatgagagccagacttactcagttccagttaattgttatgtaagaatgagggcccagtgttatcagaactttcaatgttttgagagaatcctaaagttcagatttttatgtgaaatctattctagtgttaaaacatcagcaatttggccgggcgcagtggctcacgcctgtcatcccagcactttggaggcagaggcgggcggatcacgaggtcaggatattgagaccatcctggctaacagggcgaaaccccgtctctactaaaaaaataccaaaagaattagccaggcatggtggcgggcacctgtagtcccagctacctgggaggctgaggcaggagaatggcgtgaacccgggaggtggagcttgcagtgagccgagatctcgccactgcactccggcctgggcgacacagcaagacttcgtctcaaaaaaaaaacgaaaaaaaaaaatcagcaattcattcaaatttactaaaaacaaaaccaaaaacattgagtccgccaaacgaaacacattaagagaccagacttggccagatttggcctgagtggtgccaaagtttccaaaattccttctgacttcagacttttgtgatcctatatagccaatttcttccccttttgctaaaacatatggtagtactccctgtatccaaattatgacagctttggaggagctctttggcaaatgctagactataaaaaatctacaaggcctcgaagattaaaaaatatccttttttcatagccgcactattgataaaattcagaggcctcataccacgggaggccatgataggagaattgcttcagcccagcagtttgagaccagcttgggtatcatagtgagacttcgtctctacaaaaaatgaaaaattagcggtcatagtggcacctgcctgtagtcctagctatttgggaagctgaggtagcaggatcatttgagcttgggaggtcaaggctgcagtgatgagctgtgattgcaccactgcaccccagcctggcaacacagcaaggacctgtctcaaaaaatcagaggctccagaagttaattacctgtatttattgtccctttcaggaacgattagtgtgatttagttccaagattcagaactgctcctctaaatattttacttcctgttctgcctttccatcttaatgtgaaagaatcaattttggtttccacttggatgaggggtatttataggcttggctgatggtgttcagacaaagcaatcttcattgtctttaacctggcaatatttcaccacgtattctgtccctcttccttaacagagctatctggggatgttcttgaatttcaactagatggataaattaagtgtttgacttgtagaagttaatatggcaatttcgatttttttaaaaagctatttatatggatccaaaaaataaaaaggtaaacataatgaatggatttgcagtgaaattctttaatacaagtgtgtttttaaagctgagtttcttggatttgactggctgggatgtgttatttgctttatgtcaatgagctattctacaaacaagtgggcctgacttaaagttcagagcagatgttgacaatgagaaggaagcatttgagtacataaaacaagaatgacatgttgagagaaaccacataccttactgtgactgagctgactacagaggacaaacaagaggctctgaatgacagttttgagccacgatttgcccttgtcctagccccagtaatgagtcagcccccaccctttcacatcagcgagtatgttaaccatcactgaatgtttaacatttaaaaccgaatcggaaagaatcaggtaattatttgatcattacagccatgtcatccgatgttatattggtaaaagatttggattttaatttttttactcatgtatttggctagcttttcagattcaatggtggagacagactctaagctccagagaggaaggggccacatctccttcaccccacaatgccttctaaatgcactcagttcattttgttgaatgaaagatctttgattaatcatttgaatatataggagattttaggtaagtaggctttcaatgcattcattcattcattccatacagatttgttgagctttccctatgtgccaatcataattcttagtgctaggcatatgtgatagacttgtgggctagtcccttaacaaataacaatctattgtaataaatattatggcagagatgcttaaatcggtgtgagaccttggaggaggaatgactgatgtagagtttcacagatggcatcaagatgagagaaacagtttgggctcagtcttgaaggaagagtagaattggagaaaggcattccagctgcctccagctactaacaggaactgaagagtcaaagcttggacgagggagggagcatagctaaaatgctgagtcgtgagctgtgggttggggggcacagatttgttggacatcctagcattacagacttttagaagaaagaatcaggtaactggctagttatttaaagatctggatatctgatgtcatatgaacacaacatggttttataaaaccaatgctttcatttttgtttataatttttgaataacattatagttttagtgatggacaactgtaagcttcatgagggaaagaatgattgtcattgatatcttagtgtccttttgtaattaatgaaataaaaccttgtgctctgctaatgggtaaactgtgggtaatgaggaaccatggaaggatctgaaaaattggaagcagaattgagatgaccagagagccacggtttaggaagatggatctgggagcagctcggcagatgccctgcagcagggagacagtgtaagctgagggatccacctgtaggcagttgtgatggtccaggcattcgcagaaaagatggagaggaagagtctgattgcagaactctttgggggaccctaggatgctggagacgggtagctgggattcaaggaagagctggaatgcaatgaagtggaggctttgtgcttgggcaaatggaagtacggtcatgacagttttccaggtaaaattcaggaggagaaattaagaattgagtttgaggggcctgggcacatccagttgagatcttgacatggaaaatggtgaaaaattcgttagaaatgtggatctggagttctgaagagaggtcagagctggggatggagacttcagacttcttgcttgagtatctgtgatcacttggtggcgttagagagagcctgggagagtcttgcagtgggctcacgaaagccaagggggcagtggttcataaaaacagagacgtaaacagtgtcaagaatgaggaggctgtgctgacaaactgtgaggatgcagggaatgccatagtgaaacactttttattgtctaggtgcatcagaagccagaaatcactgagtagaggaatgatgagaaggtgaggaagcagaggtagggagagtaccctttcatgcttttctaagaaaacctttgaaagatgcaactacagtaacaagattgaacacttactaaatagttactttatgcgaagctccgtgcctgtgcttcatggccaggcttgaaatcccctgtaggttttagcatatgcttggatggttactagaaacatgctcatgtgaaatacaaacttaaaatggagttcttcatttgctttttgatgcacattgaattaccacctttttttgcaaactggttttgaaagggagatcctaggagtctttgggataaggaaggggtctctgaactggggaaaccgcagcaaactggggtatgaagaatgcaaagatgaacttgactgtgcagtgcttatgagacaaagtcagcatttgtcagctttcattctaccaacaggtaccctaataactgtactgcaacatctggaaagggggtggtagccagctatgtggtttcctgatttgaggagaaaaggaaagaaggaaagaaaggaaacaaaagcaaaccttgtttggacttcagtgcttcttgattttgtctttttttggctgtcactaacctgggggcttttcaatgatctaagagcagcctatgattgtcattctggtctttcctcactgagactttcttcttatttgctgacttttctttccatcaggaaattattctaagagatgttgaaaaatgccattaccatatcctgttattatttttgggtggggggagagatgtggtactaatgtgtgtatgtgtgtgtgtgtgtgtgtgtgtgtgtgtgtgtgttttcagtgcagttgaatctgaaataatgaaaacctagaaccaagtatctaacagaagatgtcctattatggcagggaaggaggagagtcgaggatgttctggccagaggtctttatagggaaagtaccttaaagattttgggggagctatatgaggataaaataactttttctgactaccagttatgtctaaagggatttaaaaaaaaaaagagtgatacttcatattgagattactatgtgccaggcactgggctaagtgctttacagaaattaactcatataattattaccacaatctgatgaggtaaatactgtcattcccctcacttttcagatgaagaaaaagaggcagagagctatttaagtaacttgctgaaggtcacactcttggctggtaccagagctgcgatgtacactcgggttatccaagacaccagccagtgtgcttattccttatgcgaaattttctagaatagacgttctcatgtactcacagatgtaagtatctgtgtgtgtactcgtatgagactgtagttattgaaaacacagagaagtggaaattcaacctgccattcttttgaactacataatacctttaccaaatgatcacagcctctctcctgctacctttcccacactgagaggttgtttggttaatttgagcaaattaataggtgacagtcattatcctgacagccttataattatcatcattcacaccattatctttgttagaatcttctcaggggttttcctgccaggcccatgcctgttctgttggggactgcggataaagcagaattggggaaagagcagaacactagggtatgaaaaatgcaaagataaactcgactgtgcagtgcttaagagacaaagtgttgtaatcccagcacttcgggaggctgaggcagacagatcaactgaggtcaggagttcgagacaagcctggctaacatggtgaaaccccatctctactaaaaatacaagaaaaaacattagctgggcatggtggcggatgcctgtaatcccagctactcgagaggctgagacaggagaattgcttgaacccgggaggtggaggttgcaatgagccaagatcctgccattgcactccagcctgggtgacaagagtgaaactctgctcaaaaaaaaagaaaaaaaaaaaaagagagacaaagtgttggcttttgtcagctgagtgtggcttggacacaaagaattggggcaagtatctgggcactgactgcccagaggttcttggagctgctcctcctgggtcttttccttggctgctgcacagcagaagggtggcatttggggtggttgaacctgtgcttggctatttgggacaatgggaaagagacagaacaagacttttctctcttctggctggcagtggtgtgttcttgctctttctggagccataagggtgaaactgtgctcattctctagccagagaccagccaacagattctggggatttgccacgttaaagtgtggggttaatagcattgccaccaccagtggggacagagtcaaatacagcaagtcaggaaggagcaggcaactgtacattcctttggtcttcctctatggtccagtgtgcttaggaaaaaaaagtcatattctcctgaaaggatctaattattctgctcttttgttttgtaaagttttgtttaagtgttctaagtattaagaaataactaaagatttaaaagtttccaaagccctagatttctaaataatccagtaaccagttgttgttctagaattctggggtaaccagtaactactccttagacaatggctatgaaattaccagaaatcccttaagttccagattcttcaataccagaaaaaaaccctaaggttgtgaaagtaatagctaacatttattgagggttttttgttttgttttgttttttgtttttttttttactgtgtgcccagcagtgagctttgaatttgcaacccactcttatcctattttacaaatgagaaaactgaggctcaaagccaacaaacaattggcttaaaatcccatgctaagtagcacagactggaccagaacttagatacaaacttgatttaagaagcctctgatcttttttttatttttttatttttttaattatttatttatttatttattttttattttattttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggcgatgactcttaacgagcatgctgccttcaagcatctgtttaacaaagcacatcttgcaccacccttaatccattcaaccctgagtagacacagcacatgtttcagagagcacagggttgggggtaaggtcacagatcaacaggatcccaaggcagaagaatttttcttagtacagaacaaaatgaaaagtctcccatgtctacctctttctacacagacacggcagccatccgatttctcaatcttttccccacctttcccccctttctattccacaaaaccgccattgtcatcatggcctgttctcaatgagctgttgagtacacctcccagacggggtggtggccgggcagaggggctcctcacttcccagtaggggcggccgggcagaggcgcccctcacctcccggacggggtggctggctgggcggggggctgaacccccccacctccctcccggacagggcggctggcggggcagaggggctcctcacttcccagtaggggcggccaggcagaggcgcccctcacctcccggacggggcggctggccgggcggggggctgacccccccacctcccttctggacggggcggctggccgggcggggggctgaccccccacctccctcccggacggggtggctgtcgggcggagacgctcctcacttcccacacggggtggctgctgggcggaggggctcctcgcttctcagacggtgtggctgccgggcggaggggcttctcacttctcagacggggcggttgccaggcagagggtctcctcacttctcagacggggcggccgggcagagacactcctcacatcccagacggggcggcagggcagaggtgctccccacatctcagatgatgggcggccgggcagagacactcctcacttcctagatgggatggcggccgggcagagacgctcctcactttccagactgggcagccaggcagagaggctcctcacatcccagacgatgggcggccaggcagagacgctcctcacttcctagacggggtggcggccgggcagaggctgcaatctcggcactttggggggccaaggcaggcagctgggaggtggaggttgtagcgagcagagatcacgccactgcactccagcctgggcaccattgagcactgagtgaacgcaactccgtctgccatcccggcaactcgggaggccgaggctggcggatcactcgcggttaggagctggaaaccagcccagccaacacagcgaaaccccctctccaccaaaaaaatacgaaaaccagtcaggcgtgggggcccgcgcctacaatcgcaggcactcggcaggctgaggcaggagaatcaggcagggaggttgcagtgagccaagatggcagcagcacagtccagcttcggctgggcatcagagggagaccgtggcaagagagggagagggagaccgtggggagacggagagggagaggggagaggggagaggggagagggctttaaaaatcttttgtagagacagggtcacaccgcctctgatcttaacattactcagttcctatcgttctggaaccagatgctagagaaatgtgccttcttcctgtctaccccatcttcatggtaaaattaagaataaagaataaaggaaagctaggaagtaattgaaaaaattgttaacttgcttaaaatagttttctgttatctccttcctccatatgtacctaaagcagcccaaggacactgatgttgacctcggaaaccctgaatttatgtttttttctcattgttcagattcctctttcaggctatttaggcattcctgcacctgaggagaagctttgctctgttgctcctttgtttgaggagccataataaccaatgaaataagcaatacataatttcctgattgtattttcctcatacaaacctgttactaggttagaaatttgggtgtaggtataggtggggagagtggatgtgggtggcaaggagggccattgacgaggtgggggggctcgtatttatgaaaagtctcatgcagctgctgttaattttctaagtcaggccatatatttggtcattgtaactgtgtgtttatagcatacatcttttaaaaagtaaatttgttgtgttataacctacatccagtaaaattcaacaattataagcatacagtatgatgagttttgacaaattcacatagggtttacattaatttttttggtaacagatttattaaattataaattacatataattcacttatttaaagtgtataattccttgatggctttagtatattcagagtagtacaaccatcactaccatcaattttagagcattttcatcacccccgaagaaacctcatatgcattagcagtcactccccatttctccctaccccaaaacctcccagccctaggcagccactaatctactttctgtttctacagatgtgcctgttctggacatttcacataagtggaatcatacaatgtgtggtctctttcaattacattttctcacttagcttaaggtttttaaggttattcatgttgttgcatgtataagcattccatccctttttattgctgaataatagtccattgtgtagatatatatcatactttatccattcatcagttgatgggcatttggatccattatctatatatgtttatcagtttttatcacatataatatataaaaatatttagtgtatatatatgtgtgtgtgtgtgtgtatatatatatatatatttgagatggagtctcgctctgttacccaggttggagcgcagtagcacgatctcaggtcactgcaacctccacctcctgggtttaagcgattctcctgtctcagcccccaagtagctgggattacaggcacccaccatcacagctggctaatttttgtatttttagtagagatggggtttcactatgttggccaggctggtcttaaactcctggcctcaagtgatccacccaccttggcctcccaaagtgctggaatacaggcatgagccactgcacctggctgaatatttagtatacttaatgtattctatctatagtctatcttaatatatagactattttctatatatattaatcactggctaatagcattcatttttaagatgtagatatttaatcgaaaccttgattttcatatcctcttttttcttttcttactttcaatatttagtatgctagtagtcagaaacatgaaagtagcttaatcccatcttgatttctgagacaatctgatcaaggccaccacaactggatttacagttgtacgaaaattattatttggaggccaggcgtggtggctcacgcctataatcccagcactttgggaggccgaggcaggtggatcacaaggtcaggagatcaagaccatcctgatttacacggtgaaaccccgtctctactaaaaatacaaaaaaaagttaccgggcgtggtggcgggcgcctgtagtcccagctactccggaggctgaggcaggagaatggcctgaacccgggaggcggagcttgtggtgagccgagatagcgccactgcactccagcctgggcgacagagcgagactccatctcaaaataaataaataaataaataaataagtaaaattaaaaggccgggtgcagtggctcacgcctgtaatcccagcactttgggaggcagaggcaggcggatcacgaggtcaggagatcaagaccatcctggctaacagtgaaactccgtcttactaaaaatacaaaaaaattagccgggtgtggtggcgggcgcctgtagccccagctacttgggaggctgcggcaggagaatgacgtgaacctgggaggcggagcttacggtgagccgagatcacgccactgcactccagcctgggcgaaagagtgagactccatctcaaaataaataaataaataaataaataatacataaaattattatttggagttcacccccttgaatagctatttcaaaccgtagaaaattcttatagaattgtgtgtgtgtgtatatatagacatacagaatgaagatgactcaatatgattttacaaagagttttaatactttagaagcacaacagggtggattctttttcttttccttaaaaactgatgttgatatataagtatatttttttgactttagaagagaaatgatacactgacatcttgaaacgtcattggaaagtgacaaaattgatctagtgactataacttttaaaggacttacgttagtgttaacatgatgacatttgctaatacatcaatcaacaaagagagtagatttacttgacagtttaggtctttgacccagaggagacttactttaaagttctgtcctacttaaaaattgttataaaaatcagttataagtgtgttgacactgttgcagctgatgaccgcagatgcactttttaccccttgaacagtataaaatgaaattgcttaagaaatgggaaggcaaaagtagaagtagaatattacatgtggtatggagaaggcggactcaagaactagagataagatcacttgtgttatgtgtctcatgaaatgaaatgtaattaatttgtatttgaattgggagcttcagtttgttttaaatatatttgtgtacctattgttttagaattcccaaaaagttatctacatttttgcttacatttcatgaaaacacccaaagaatgacttgtttacctacatttttttgtttgtttttaggtattggttaattatttctcaattcccaggattccttcacccaaactgaggtggtatagaataaatgatacatgtttggagggacaaaagtcattgtttgagggaaagagtgatatcagtattacaactgcttctggctgaacaggtttgctttttagtttataaaacttgttacctacattggagtcagagctaaaacataattttcagtagcttttgaagtgttttattttaacagctttattgaggtatataactcatacatgataaaactgatccatttaatatgtgcagctcagtgatttttagcatgttcatagagttgtgctacctgcaccacaatctaattttaaaatgttttcatcatcccacaaagaagccctgcaccctttaacagtcattccccatttccacccctcaaacttttttccaaagtggcttcagccttttcatctgccacagcagcatgtgagggtttcagtccacctcctcgcccatggtttatagccttaaagtgtcataaatgtaactgtaggaaggtcatggaacccagcatgatttagatttttgattcacctcacagataactagatcaaggcaaaatcaacctggaatcaaccatttttttcccaagataaagtcacaggattctaggctcttaaagtgcttcagcaccagacaatccggtagtgattgagattcaaataaaaatgtgctactgttgacctccttttatatttcaagtgaaaagtctatctatgaatctttaaggagatgtttatagacaatgctcaaatgggggttattagggaaagataattttggggaagggagcaaaggcaacaggaaactgtcagctgaaaataagattaaatacttgtaaatcactttgtatttggcaaaaattagtatagtgcatatgtatacatttcagggatagaaatactcagtgttcttaaatgtcacacctgcagttctgacagcctatatccagagcagaaattttcagccaatgtaaagagttgaagaaacaaaggattggcattatttgagcagaactaaacataatcgaaggtgctggaacttaaagctttattgtgaatgaaatgtagtctttcatcaatagtctttttcgtttcccgaaggaagggattagaacttgccaactctcctttccccttaaacaaaacaggttctggctttaggagatatactatcctttctactaatgataatctaattttgttgaatagtgatatcttcttatggttaatattatttcatgctcttctctctcctccaagggaggctcataatacatgtactgtatttaatttttttaagttaaagttaagaaagatgcttacaagttcaagttcaaattcaaattaattctgtgaaacttctttaaaccctgtagtataaaaaaactgcccctaaattagtgttcttcaaatgatctctcaaaatggtttctaattttgagttttataaggtgtctggtcactcagagtcctggtttgttaacactctggttgaaggagattccaaattctcaaatagtttactagaatgtagtacaatatctatttcttagaaacacattttcatacatttgaataagactccaaaacgttgaatgtatgcatggatcataaatctaaataacatagtgccttctgatacttacagatcttgtttcattcatttatttacttacttatttatttagagatggagtcttgctctgtcacctaggctggagtgcagtggcgtgatctcagctcactgcaacctctgcctcccgggttcaagcgattctccagcctcagcctcctgagtagctgggattacaggcgcgtgccaccatgcccagataatttttgtattttttagtagagacggggttttgccatgttggccaggctggtctggaactcctgacctcaggtgatccacccacttcggcctcccagagtgctgagattataggtgtgagccaccctgcctggccttttttttttggaaaaaaaattccaccacttagataatataaatgattaattctacaatatgtagaaacaattatttcttgtggttataaacacagacttcttgaaacacatttttcttgaatttacatggagagtaccatttttctaatcttgttttgctctgtgagccctgtaagaactgccctctccaactccaccaaacctatcgggcctatcctgattacacatgtatgttcatgttattcctcttgccttggccgcccttctatgaatcccttcattgttcttcacaactaacctactttatgaggcccttccactcctgctcccatcttgagtgctttcatttccttcgactcctaaacatttaatatccatccacttgtatggcacccaatcgtgtacgtactcttttgcacatacctttccacgtggacacaccttcccatgtacacatatcttaccttcctaagtgagttaaaagagttcctgaggtcagggaccataccttatatgccttctggtctcccttagtagctagtgcaatataacttaaatgtaagtgatcaagaacattttgaataaagaccactttcttcttttttttctttttgagacagcatcttgatctgttgcccagggtggagaacagtggcataatcatggctcactgttatggctcacctcctcagctcaagctatcttcctgcctcagcctcccaagtagctgggaccacaggtgcatgccaccacacccagctaatttttaagaccacttttatcttgctgcatttctataaacattaggataaatgggcttagtggaagttttagttaatttggaatttttatgaaaaagagtgccaaataagggaatgtatcatattagatcataagatatgaagaagggaggataataagaaattttcataaaaatagatatggcacatctatatttcttatattctatggtcatcaacaatattcctcagctttacctttgtcccaaatggaaccaagtggggtatggatggttaaaataatcaacttgaaattactgcatactcacaatatatttattcagctgcaggtaaagaaatgagtaccgataacttaacaaaataatttactgggttagctcacaaacgtggaaggttggagaaaccaggcttcggtatctctaggaggtcaacgtagtaggactgacagaggtctcttcagtgcactttcatggggatccataaactccgcagattttcctttccttatatagcatttcactcaagattcaggcatttcaatcaagattcagagtcctgaaagcctactggcttctcttgggttagatgccctttattgctcaaggtcaaggaaacttaattaacagtcccacaagccctctagccataggactgatctacatcctcaaaaaggaagttgagcaccattacaaaaaaggagaaatgaaggctagcctattcataaaatcaccttacgcagtacagaatatcagaaaaacagctggtgagaggcacctagggaatagaggaagccacgggaggagggtactagagtgacagaatacaggaaatcactcaatggtagttttaactgtgttctattgacactacatgtatcttaaactctgagatgatgacagatcagaagctgttagtcatcgctataaaaacttgcctttctagtcagagttgatgtgcatgggaactttgtatttccaaggtttgctctcttaaatatttactgtgagaatttctttggctcttgtcctacatcctgaaatgtcaccgaaggcagggcatggcaatgcaagggagggcggaggtgtgtggtgtagaaaggcatttttgtctacttaggtttgaaaactggtaagggagataattctcttcatcctcccccattgcccgcaacctcccaggaatactggctttattcatgattctggtgctttgtctctataaatgtgtacttttcctgaagtgctgtgattggagcatttgaatgaaggacaatctcgtatgcatttgtcttcacacaacctcttagtctctttagatgtttggctatttctatcatatcctatctagtttgaggagttcagacaatattttctttaaagaggattctggacagaaattgtaaagtactaaattgtcattagaaagatcagaattgcattgtttacttttacaatagagtaggtaccagagagagcaaatttccaatggagggacatatttgattactacaaaagtttctgatttggaagtttggataattctgttaacacaatcatatggtttgagtgtctagattttatacctacagttttgttcactaattgtaacatctctctgtttttgatcattaaatgttgaaagttaatttgtgtaaagacttatgcacgtggtgacatgagttctgcccagtgctctgaaatcaaagtgaagaaataaatccatggaagcccaggcaaatgatgggtgtagctatgactctctgaaggtagccaaatgccttgtcatctaattaggctgtgtgtgaatggataattgatattcctactgtcttcagagattatctgttgaaaccacagccaagtgcatggtttggcagaatccgtgggcaaagactctgttgcacctgacagtaaacctggcatagtgaagagacatggaaggtacaggttaagtgggaggccctgctggggacctgaaggttaagccttggatctccaaatccattgccatgtaagctgtttaggaaaagaaggaaaatttttcttttcttttctttcctttttttttttttgttgttgttgagacagggtctcactgtgtcacccacactggagtgcagtggtgcaattactgctcactgtaacctcaaactcctggactcaagccatcctcccacctcagccttttgagcagctgagactacagctgcaccaccacaccagtctaatttttgtatttttttgtagagatagagtttcactatgttgcccaggctggcctcgaactcctgggctcaagccattccttggcctcctgaagttctggcattacaggcatgagccactgtgcccagcccaaagctttaaataaagtaaacaccatttggttaccaacactagtagaaatcaaaaacaaaaatagacaaattttgcctatgaagtaaaaaattcctccgccaaaatagactaacatagtcaaaacaatgcatgaaccaaggaaatttaatccaataattcatggatgcttcagtagtagaaaacatatattttatcatattaagagttataaagggaaaattgtatgaccatcttcctatacactggaaatacattgataaaatgtaataacaattatttataataacactcaaaaatataaaaatgcaaattactttcttaacttcgtaaaagaaatccaacaaagcaccagaggcaacatcatggtatttgagggcattcccactaaagttaagaacaagacaaaaatgtatacttttgttaattggtattattctgtatgtactgttcaatgcaaagacaaaagaaggaaattaggggccaggcacggtggctcatgcctgtaatcctggcactttgggaggctgagatgggtgaaacacctgaggtcaggggttcaagaccagcctggccaacatggtgaaaccccgtctctactaaaaatacaaaaaattagctgggcatggtggtgcctgtaatcccagctattcaggaggctgaggcaggagaatcgcttgaacctaggaggcggaggttgctgtgggccgagattgtgccattgcactccagcctgggcagcaagagcgaaactttgattaatcagcctatgtgcctgacactggtcttgcagtacaactggaaaccaaagcaaggtggaggatgtcctgaattaagatgttttcatctcattgtgtaacagagacagccaataaatctaccatttgattttataaaaaaggaaattggaagtataaaaatttaagacatataaggagataaaaaattgtaactgtaggtgactatatgactgtattgcattgtgcattgtatatacccaagaaaatcatctgaaaatccaccacaaataggagaattttgtaaggaagtgggatgtaaaattaacatacagacatcaatagcttttaagcatacaaacagaagacaaataaatgaccccaattacaatattagcagcgaggataaaatctataaaaatacaatacaatgaaatattgaggaacattttaaacactaagaacatagatggagacttgaacaaatgcaaaacatattatgttcttagaatgagttgacatcataaaaggtcaattctccttacatcaatttttaaatttaactcagtcctaatgaaagcatcatctgatttctttttgaaccagacaggctgattctgaagttcatatagaacagaaaacatgaatagctacaaaatatttcaaaaggagtgtaattataaagacagaaaaagccccattagagattaaaatatggtaaaaggacttttataaaaaagattctgtgatgaaacaaatgtggtaatgatgtgtgaatagacagaccaatggaacagaatagaatatccatatacacctaagaattaggaatttcagctggcttttcatctccaaaacggtacacgacatttatactgtaagaaatgcaagttgagtgagccgagattgcgccactgcactccagcctgggcgacagagcaaaactccatctcaaaaaaaaaaaaaaaaaagaaagaaatgcaagttgaaactatgatgaaatgctattttaaaaccaagaaatttgcaaaaatccaaaagtttcacaacacattcaaaatcctggagacaatatgaattagctcaatgctcttgaacttaatttggtaatacctggcctcaatgatcctcccaactcagctttttcaatattttctgaaattacaattacaaatgtatattccttttgactcagcaattcctcttttggattttacctaacaaatatgcctataagcaaaaagatatatgaatatgtaaggtttttcactgcacattgttttccattaaagccacagggactggtcgaacaaactaagataaagtcccatactggaatacagtgcagaagtaagaaatgaataaggaaggtcagtatgcattgatgtggaagatcttccagatatttgtcaagtgaaagagaacaaggcacataccaatgtatataatatgctatttttttgtgtgtaaaaaataagggaaatctatacttgagtttgccagtgtatgcataaagaaactttagaaggctatacaagaaacaagatgcattggttacctgtggaggagataaggcttagatgggaaataggtagacaggggactgtttatcttttgtctttttttcattatgaaccatgcaagtgtttttgcctattcagtgagtaaataaataagcaagcatacagccatatgtatacatcctatgtacttataaaaatgactaaggatgctgtctatgtattgatagggaaaaatctctcaggatgttatgtggacaaaggaaggtggggaatgtaatgtataatatactacttttttatgaaaaagagagacattgaaaatatttgcttggttttgcttataaatgcataaagaaactggaaaaatactccagttggtgaacattgtgatgtgctgccagttccattccaggcctccttcaggaatgacagagttcttgccccagctgttgagaatgctgccagcccttatggggatagattgcctcctttgaagggagccgcctcacctcagatcaccacccattcctgggtagccacatccagtgcatgatcaacatggaagtgtggatgggcagctcccagcacccagctcagcacatctctgaagggtcatcccaactttagaaatccccttctttataactgcaaggttatctgcagctgatcttctccctctgccatctgtgcccttccataggcatcaactcgaaagcattcctaatcagtctacttcttgctaggaatctgcttcctagggaacccaagaaactaaaaactaagaaactaaaattagtggttctctgtggttgagcagggtgggaatctggtgaaggtggacaaggttgagaaggctatatttcactttatgcctttttataattaaaaaaaattgtaccatgtgtctacatcatttattcaaattataaatgcaaatgtatttgttaacttgctatgtcagtgatattttatgcttttccatgtatgtctttggagaaccttttttttttttcactttaggaggagatatttttaccccaagcgctgtgccctaccacactctaaataagattctcttttctgtttgtttttgtttaggacctgcagagaaacgcctcctgattttgtcttacaatggaacttaaaaagtcgcctgacggtggatggggctgggtgattgtgtttgtctccttccttactcagtttttgtgttacggatccccactagctgttggagtcctgtacatagaatggctggatgcctttggtgaaggaaaaggaaaaacagcctgggttggatccctggcaagtggagttggcttgcttgc

SEQ ID NO: 227 - DNA, 6554 bp, Homo sapiens
gaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaaggtaatatcttccattcaaaaatgataataatctaatccttatttgtttatgttattaatttaaattaatttaattgtaaattattaacttaatacatgctcattgtaaagtgcccaccagagtggagacacaaagacacgaattaatttgggtgggacacatacacataacagaaattgggttatatatattaagaagtaagtgaacaaccagagagaatgtattttggtacatttcattagaacttataaatacttataccttaatataatagtaataatgaattattagtaagggcttacttatatgtgcctagttctgtgttaaaaacttttaaactattatcaacacaagaatgttatgacattgatattttaatgatcatataacatatgttagtataccaagttctttgtctactggttttctttgtgtggcattaaaatatgtataatattttacttggccattcccctggaatttttaggttatttctctatgtttagtattagaacatcctgatgtatcattcctatatatatctctgatgatttctttagaatagattaccttgacagtgttgcattgtttagagttatattcttaataaatatttccttcctcttaaaggacaaaagattgtttaaaagaaattgcaggggctgacagggcagagaaagtgactcattcagtacttcggaaaggagttcctcctttaacatacattggagtgtatttaattctcataaaaattctataagataggtgttactatgatggctatatttcaagtgtggatcacgaggtcagaggttcaagatcagcttggccaatagggtgataccccatctctactaaaaaatacaaaaattagctgagcgtggtggcacgtgcctgtagtccctgctactcaggaggctgaggcaggagaagcgcttgaaccagggaggtgcaggttgcaatgagctgagattgcaccactgcactctagcctgggcaacagagtaagactccatctcaaaaaaaaagaagtgacaccactggtcaaaatacaaagctagtaagtagcaggggcataattcttacccaggtagtctgaacatactttttttcagtactagccctacgtcttttctagtttacaggcaatatctagttctaggttcattctgtttgttcagatgttcaccatgtgaaaaggctagtacatttgtaaacatctcttatgtgatgcctgttactgcatatgttggtatagaaatgagaaaagaatgtacaaaccgcttaggagaaattaagttattagactgctattggtattaaatgacaagagctatccattatcagagctttaagttaccattagcaacaacctttaacatcctctaattagttgtaaatcataggtggatggatatatcttaaaggaacctgtggcctacaaaagagctatcatgtgtgccaaaggaataattaaatatttttcataattcaacaaagatgaaaagtaaagtgtaattaagtttctttcccaggagacagagagaattatcaaataaccttgtgaccagtacccttgttaggaaacattacatctaaatacagctaaccattatgcttgatattgctcatctagaaatccagtaaaataacttgatcctgttatcagaatgcaaatccgtaataccactgaagccaatcaaacactttcctgttacacaggaattgggtgtggggaaacaaccttcatgtctttaaatcctttttctaggagtagtggaacaaatgatgccccatctctgctttcatgaaaatttgacttgctatgtaactatagcctattaagacaaaacctattcatgccagaaatgaatagttataaattatgaacttttaattatcactagtaatagacaccggaggactagatagcaaaggctcaggaaacacttgttgggaaatcacaatatacatacacagtaggtaatacaaaagtagaggacagaacatcagatgtgcttcaaagaacttgaatgttagttggggagacgagttatgtgatgttggataaaatgataatatatttcctttaattgttacctaggtggaaaaccagggcctccaagttcaggggaaggagaatcactttggactttaccagttaggactccactttcagaggagatagaatttaggccagtcagtgaagaatggaaagaaagagacatagcattttagcaagagggaattatacaggataattcaaaaggcatttatatttgactaggaagtacacattttacttggctatagaaatgtctaagcactaaaaatttcctaccactcagatgaagtgatatggagaccagctcagatgggagatagaaccctcacttttccaaatgactcagtacctccttatggctcactcttgcctttgaggcacaggcattttactgtttgcgaactaaagctctggatggcaaaaaaaaaaaaaagttacctagctgctgatgtatgaacagaactcatgcttgaatatagagaaaagttagttaaattacatcatgatatcagttaaggtgtcacaaaagtagttactggcccaggttctatcccattatcttattgagaagaaataattccatcattagaagttttaatggagttaagaccaaatagttttaattttaagcttgtaggacctgacaaacacaccagcacaactattaatcgtatctggcacagggtggtcacagctgatattagatcaatttttagtctaggatactttaaaccacaccagaaacactaagaatccagatccagggaaataaaaacccaagcacctccatgattttgacaaagataaaatgtcaacagtcaagtagtttgagatagagagtcctatctgccattccgaggagtcatcacttaccttctttgggcttcagttcctcatctgtaaaatgggaaatgattcccacctacataatgaggttttacaaagattgaatgagataaaggttatgaaaggcatctataaaggcaggcgtggggtgagccaagaatttgcatcagaaggaggacagcagaacaccaagcacttgccctggctggtaaccaaagatcgatcgtatcattttaaaaacgatgtgcaggattccttagtgttctttggacatattgctagttgtaatgtatttttttttcctggcatgaaaaagcaaaagaaaatgttataagttacaatcttaataacatgcatagatgtgtcagaattacaaatttctttattatgtattttttctgttagtgtagatgttgacttgatacaatataatacctatatcttggggtgcttgagtagtcattgcactgcttgatcctcacagcaatcctctggtaagtgatttgctttcgtctctgcattagagagaacccagagaggtttcatgatcttgaaatcaagggcttagactggaaatcatttataatttgtctccattctttacactatacattgttgtataccaaaagggtgcttatttcttatggcttgatatttaggaacctatagaaatattttactcattaattattcctgctaagatgatttagtaagctgagtgctggcattctgcatatatgcctgctaatactttatcaatgaattaacaggactcttgtgtttaaataacagaaacctatctgtaacttaggcaaataagatactttattggctcacacaactgggaagtccaaaaggtaaacctctgattcagctagatcttaaagctcaagtgttattgtttcgccatctctcagctctgctttactttaagatgacttcttaaagcaatgataccctagcagctccaagcttatgtgctacttattgtccatgaatcagaatggaaaagggatcatctctccatagctgtagggtctctggaaggggcactgattggctatggttaactcccttaacacccagggaacaatcattcggcagccccaggagcctggctctgactggccatatggatgatgatgacaacctccaggtggaagaaggaagttcctgcagggaaaagatgataggctaaaaacaatcacaaaagcattaacagatgtcctttataaaaatagatgttttgtgtgcaaaataaggtatgatttgaaaaataagagaaaatttgaagaaaacttagcaaatggtgtttccagtaaaatggagatagtaaaattaattaactgttgaaagaaaaaatatgaacaaatatgaatagctcacacttttacagtatttgccctgtagccaggcactattctaaacactcatatgtgaattcgtttaatcacccagcctttgagtatttactcaaaggattgttttattattgtttccattttgaagattaggtaatgcaggcatagatggttaagtagcttgtctaggtggggccagggtacaaatcctgtccgctggctccaaggcagatgctcttatccaggatattgacagcctcttgattatctttctaatgtatttagccatgctgtcacattaaatttttaaaatgctttcacaggcatagagctagagtagtaacacaaattttaataatttctaaaagtactaggaaacaggatcacactgtgatcaagaactgagttgcaagctgtaccatttagtatcttggtgatctcatccacgttacttgttctcttaggtctcagttttcttttctgatatggtgatgctaattcctaccttactgggttattgtaagtattaaatgagattgttctggaaactgcttagcacagtgattggcatgtctatattagtttaaatattgatcattttccgtttcccagtcactttatagtctttacttctgtctatctgtatgtatgtatttagttttttataaatgtaagcattcatatatataaaactacaattgtgtataaagattataactgaatgcatttatgtataacttacaatagttaagtaataaattgttataaaatacattataagcaatatgtaacagagtacatacatacatcatatatatagttatgcatacataactatataaaaatgcatgcctacaaatgaaacattccagcatgaattatatatttacaaacagttgcacaaaaggagagtctagctcatcatggggaaagagtgtgggaacatttcagtctatcctaaggcagtgttgtatgttctaccatatttcatttcatcattatggctgtgtcggtggtcatttgttatcctccagtatatccctcgctacccatcagtaattagacatggtcttgctgtcatctccaactttatctcataccggattaggcttaaaggtcaacacattcattctgttacccttctcggttccttgaaagaacttgtgtacctatttttaaatattcgctttaaatttactttatctatggaagggcagctcagtatcacttaaacataattttagatgaccaggtacaactaaggaaaattgcaccttatcatttaccagtatggccctcctttcattgtatttttagaaacaagaacaagaaatagatcaagatatccctcatgtttccagtgtgtggtatgtcataagggtgaatcccagacagtgctaaaaaccccagaaaattgcaagcaagactcagtctgtgagttaagaagtaggtcgcaggggtgtggagcttaaaaatggaaaatgtaaaaactagctattactcaaagcaagaatatttgtaaggcaggagatttctagtaattttgccaaagagcctctttgataatggcttattttaaacaacctgtcatggcctagctatagatctatagcaggcattttttaactttagcatgccagcagttaattagaggagctagttaaaaatggaagttcccaggctctacccccttaaactgccgttttgcactgagaacataagaagtccatggtccatggactgccctttcaaaaccgctgctctggagcccagatccccagaaataacttacagctgatagagctctaaaacaattttgaattcagtttctgatattcaaagttagatacattataaaatttataaaatcatttataaatttctgtcatttctaaaatatttttgtatctttatcatcttctttatcagatatacaatatcaggacatgtaacttgttcatgttacagattgccatgaaaatagtgagaataagaaaagaagcacaagtatcttttttcaggaataaagaagaaacaactataaacaccagggaaatacaaaaagttgtataacaaagtcgtgtataataaagatgcaactaac

SEQ ID NO: 228 - DNA, 39836 bp, Homo sapiens
ggcttttacaaagagatcaacaatagaacaggagaaattctaccagatgcaaaaagaaaagggcaagggagaatataaacgtttgcctaattcactgatctgcttaaactgccttttaatgcttagaaaatagaaaggatggcacgatcctttgatgaaaggaggctgtttatgtcagaagaagtccagacctctcacagtgacgaggggagaataaaaaagctgcaacatcaggcgggtagtcccagtttcctccctcagttccgtgccaacaacctaagggtgctcgtctggcagggtctgtcctttttcacgtctttggagctcatcagtttttgggttcagctctctggaggtggtgtcctctctaaaatctagaatgtaggcaccacctgggaccccttctgccaaaggagatacaagcagagctggaggtcaacaaaccatggtgctcccaccctcttcaatcttacttcaggaagtgactgtggagaccaaaggcaggctccttggtggccctatccaagctgagctgggagtgaacatctgctggaatcccttggtagaaggctgggggtgctgtaccaagagattgtcttttcagaaatgtggtgagcaattatgcaagattcgagagctcagcagaggaaaaggggctcctagctgggaaggaagaaggaccccagagctttgaaacacacatttacatgcatagacacatgcacacacacacccccatgtattcataccgtgtgtgtatgaatgtacagatgatccctcactcatgatttgacttaacaatttcttgactttatgatggcacaaaggcaatatgtatttgtagaaaccatacttcaacgaacaacacaaccattcgattttcactttcggtatggtagccaataaattacataagatgattttgctcaactgtaggctaatctaagtgttctgagcatgtttaaggtaggcgaggctaagctatgatgttcagtaggtcaggtgtatgaagtgcatttttgacatacggtattttcaacttatgatgggcttataggaacaaaatcccattatcagttgaggagcatctgtttgtggagaaataatcacaatcctggaacaactcatctgaccaaattttctaatgttttatatctcagattacagtagaaacatgattattgtagaaaaaaatcaggaaatacagaaaaatataaagaaaaaaataatcccatcacagaaagaaacattaaacattttgcatctggcactctggtctttgaacttggcagatttagtgctctttattttgtttttcaatattggaatcacactcaatatactgttttatttacgttgacaatgcactgctaacctactttaagttatgaacatatcgtggacatttccccacatttccacgatttttattgttggtataatattcatgttaggatgtgcccaaccagatactttaactgcaatcaagataaacccatttactcagaatcttggctcacagcgtaagtaaaaatgactggatctctagttgggccctataatgcgaaaagtctcactacaccaggacggtatgttactggagaatggagcaggcgcagaacagggcagcctgctttctgtctctcctgtgtttctgggaagagaagctattttctcccctcctcctctgctgtgattagatttattttctaatctctctctgttcatttgtggtttattgtttgccagaagtccccatgtctgttgttttgtcattctgaagcggcttcgttgtctggggtaaatacccagggttcgttacctggcgccaagaaaatttaggacagggacacaaaggaggcctttaggagcgcaggtttaataggcagaagaaagagaaaggagaacagctttctctctagcgagagagcggggcttctgaaagggaaagacttgctggggcggaattctccaaatttttaggcaggtttgaagaggcggtgtctgatttacatagggcccacagatcagttcgattaggtgtgatgtttacatagcaggaggaaggctggctacctcaccctcatcttactatgcaaaagagctttccacttgacccgcgccatgttgtctgttccttaatgtacacgtggctggcactgagaaaaggaagatgggctgggcgcggtggctcacacctgtaatctcagcactttgggaggccgaagcaggcggatcacgaggtcaggagttcaagaccagcctgaccaacatggtgaagccccgtctctactaaaatacaaaattaactgggcacggtggtgcattcctgtaatcccagctacttgggaggctgaggcaggagaatcgcttgaacctgggaggtggaggttgcaatgagcctccaccatgccattgcactccagcctgggcgacagagcgagactccgtctcaaacaacagcaacaacaacaaaaacaaactaactaaccaaaaaaaaaaaaaaaaaaaaaaaaaaaaggaagagaagatggaaccgccattttgaacatgcctagtcccaggtagtattcctctgctggcatctatgtctgtagcttgatttcacaggctgctctttgttagaaaggaaaagtatttggggctggttttcattaaaaggaaaaccttaccgaggacttctgtaccctcactatctgccgaagtaatttatttttaacttgtgtattctctgagtggttcagagaatcttaataaaagaggaggaggtagggtgaccctcagcacttaggaaaatacggacacctcattctggagtgcctgaagtcagcctgcaggaactccctgtgtctgagaggcagccctcgctcttcctgagctagtggcagaggaaagcggctggaacagcagggtcctgtagtgtgggtgggagctttaactcacgctccttcctatctgttcccacttaaaaccatctgggctgtgaggaggtaattttctagcccttcaacttgtgtgaccacacacattctttaaagagatgtttactagcttcacaggattaaaaacaaattctcctttaaaaagttcaaaacaaacaaacaaaaaaaaaacctctcagttttctctgtgttccctcttctgactctccataagaaaggtatttgtggcctctctgaaccatgactcagattttcacttgagttttgacttttctcttttccctacaacttcctgttgctgctgtgaaatgctgttgcctgagagggcttttcttttttcccctgatttaactccaaggtgatttatgggtccctgtctcgatctatgtctcagtagagatgaggggaaaaagagacggccaagaccttcacggcctcctcattctcctgaccttagagtccagctcacacagaggctggctaggagtggaagtgccacttctccatgagggcggtccccattcctgacagtgccaactgaggattgtacatattttaggcagaaaagcacaggacctttgttttttagaattccactctgatttttcttcttattttttccctgtgctagtgacccaggaataaagctagggaaagagaaaatgtgatcattccggcctggggaaggtgaaaggacaggatagcaacaaataacagagaatgatgcataacagcatattgatagtcttcacagtttgcagagcattttcatatccattatctcattagctcctcacagccgcctgcggggaaatgcaccacaggcattgtgcttatcctggtctgcagactaggagctgcaggtctgcgatggatgctgtgagatgtcacccagacccctcgtcagggcggagaaactcactccccagctgtccagtgcccactgcaaacagccacaattgagtccctcactgggaattcccccgctgaaggaagctgcctttgccaaggttatctccctccctgggccctgccttgattccaggcaactctacggggccatcccagctccagaacaccctgtaggatcagctgagaaccctaggatcagctgagaaccttgtagcagctgcatcagaggtcagcttctctctctgcccaattttcctttcctccctctctccctccgggggttgctcttgagagctctccctgttaaacttcttgcatgcaagtccccatctgaaagtcttccagggaacctcactgtattggcccattcaggctgccataacaaagtacaacagactggtggcttaaacgatataaattcattgtctcacaattctggaggccagaagtcagagatcacaatgtgctctgggactctcttcttgagttgcagatggctgttttctttgtgtcttcacgtggtctttgctctgtgcacatctgtgttttcaatcttcttataaggataccagtcatattagattacagccctctctaacaacctcattttaacttaattacctctttaaagactccatatccaaatacaattatgttctgaggtacccggggttcgaggtatgagttttgggtggccacaatttagttcatgatacctacctaacacaatgttgaagagattgagtgacatgccccaaataaagcagtgtccccttatttaacaacttataaaatatcttacagccctgtggttctccctgatcttctgccacttataccttatgtaatggaatgggaaggtatcactgccaggaaatcaagaattaggatccggagtttctgtgctctgttcgctactacacgtgatctaccacaattgggaatctaactcattctgttctgctaaattgttgccagtgctcacaaacgcacattgtagtggacagtataataatattattgttaactgatgttattaatgaccacaaaatgacaaaattaaggacacacaaaaaaatcacctggagtatactcttggtgaagcaataacacagggtacaaaagaatacagaatacacagatctgggtctctgggataaagactagatcctaaaaattgtaactgatcagaaaaatacagagctgtatggtcccaagtgggaaatatttcatacaatggtgatctgacaagcttcaaatttttttcatgtgtaatgatgtgattgttaaacactagatacgcattgctggaaatttgattttccttgtctcctgacaaatccacacggatgaaacgctagctggaggagattggggagagaaaagaatatgattttaaatcaaaagtagttttgccttgaaaacagcatgctgtaaacttgactttagattctcactccactccttcctatattgtgtgctatgcaagtgcttttgtttcattgtgcctcatttttttctcagctataaaatggagataacaattttttcgttgtagaattattgtgaagattaaacagatttattttttatttttattttattatttttttatttttttgagatggagtctcgctctgttgcccaggccagagtgcagtggcgcaatctcggctcactgcaagctctgcctcccgggttcacgccattctcctgcctcagcctgccgagtagctgggactacaggcacctgccactatgcccagctaatttttgtatttttagtagagatggggtttcaccatgttaaacaggatggtctcgatctcctgaccttgtgatcctcccgcctcggcctccgaaagtgctgggattacaggcttgagccactgcgcccggcccagatttattttttaaatgtaaagcaccctgcacagtgctggtgtatagcaggaactccacaagtgttagtttctggctcattagagagaaaacctctcctgctaatcaatgcattgctacagctgccagcaaaatgagagaaagaccttcaatgccacccccaaatctatcccttatgcataagggaggtggatattctctttcaacttcaggattgctggtggaggcctctgcatcactgcactgagccccgcaataatcctgctagctgatctttcagggtccccagaacaccggaagttctaaagggttaatgcatgcaatggataaggaagagaataaaccaagtaagagaaagagagagagagcactatacagatgggtctttcttttttcttttaacttttattttcggttcaggagtatatgtataagtttgttacctaggtaaacttgtgtcatgggggtttgctgtacagattatttcatcacccaagtactaagcctagtacccaaaagttatttcttctgatcctcgccttcctgccacactccaccctcaaataggtcccaatgtctgttgctcccctctttgtgtccgtgtgttctcatcatttagctcctccttataagtgagaacatgaggtatttggttttctgtttctgcgtgaatttactaaggatagtggcccccagctccattcatatttctgcaaagcacatgatctggttttttttaaggcagcatagtattccatggtatatatgtatcacattttctttatctgatctgccactgatgggcatttaggttgattccatgtctttgctattatgaatagtgctgcaataaacatatgtgtgcatgtgtctttatagtagaagaatttatattcctttgggtatatacccagtaatgagattgctgggtcgaatggtagttttgtttttagctctttaaggaactgccatactgctttccacaatggttgaactaatttacactcccactaacagtgtataagaattcccttttctccacaaccacaccagcatctgttattttttgactttttaatagtagctattttgactggtgtgagatagtatctcgttgtggttttgattttcatttctctaatgatcagtgatattgagctttttttatacacttgttggccacatgtatgtcttcttttgaaaagtgtctgttcatgtcctttgcccactttttaatggggttgcttttttcttgtaaatttaaattccttatagatgctgaatattagatctttatcagatgtatagtttgcaaatattttctcccatactgtagatcattgttgtttactctgttggtagtttcttttgctgtgcagaagctcttaagtttcattagatcccagctgataaacaacttcagcaaagtttcatgatataaaatcaatgtacaaaaatcactggcatttctatacatcagcaacagccaagctgagagccaaatcaggaatgcaatttcattcacaattgccacaaaagaataaaacacctaggaatacagctaaccagggaggtgaaagatctctacaatgagaattacaaaacactgctcaaaggaatcagagatgacacaaacaaatggaaaaacattccatgctcatggataggaagaatcaatatcattaaaatggccatactgtccaaagcaatttacagagtcagtgctattcctatcaaactatcaatgatattcttcacagaactggaaagaaaaactattttaaaatttatatggaatcaaaaaagagcctacatagccaaggcaattgtatgcaaaaagaacaaagctggaagcatcacgtcaaactatactacagggctacagtaaccacagccacctggtactggtacaaagagacacacagaccaatgaaacaggataaagagcccagaaataagcctgcacgcctataaccatctgatcttcgacaaaactgacaaaaaccagcaatggggaaaggactccttattcaataaatggtgctgggataactcgctagccatatgtagaagactacatatacaccatatacaaaaatcaactcaagatgaattaaaaacttaaatgtaaaacccaaaattataaaaaccctggaagacaacctaggcaataccattctgtacataggaactagcaaagatttcatgacaaagacaccaaaaacaacaataacaaaagcaaaaactgacaaatgggatctaattaaatctttttttttctgtttattctgttttcaaatactcattatagaacatttcacccaattcaaaaagatacatagaagagggtgagaagatttaacattttggtgaacatccttccatgtctttctttatgctaaaatacatgagtgtaaacgacttttaaaaaagggttttacactatgtgctagtttgaaaactgcatttttttcaccaataactcatcatacctattcatcatatcaatgaatatagacagacagtctttaatagctgcaaaatatcccattgtatgtttcagaatttatccaatcccatattgctgaatatttaggtactttccatttatttgttgtcaattataataaaatattttgttaaacgactttgtatatgcattttctcaaacttgtccaattgtctttaggataaattcctagactaggattgcttggtcaaaggacactggctccataaaagtgattaacaatttaccttcccagctcaagtgttagggaaatcccaaattccagctgtctcacttcaaattcatgatgataaaatggaaactcaacactggaattctattatacatctctacgtggtttgctttcctactcttttaggataattctaaatcttttcattatgccttaaccctactgcaccactttcccctcttatatgctcagttgatgtcctggtttcattctttaaaaaaaaaagtcatgaagcacaccaccattttctgtacacccctaaatcaacacacccctcccacccccacatacacacacactggaacccattttctctaccttcctccttcactgtggcagagtccacatggctggcactgttcagcatctcacttgagccacatttacgaaacaactcaaggacttctctccttctcaggtactgacacataaaatcaataccaaaactcaacaaagatagactaaaaagaaaaaataggtacagatcaatatcatatcactcatccattctttcagtacacatttattgaacacctactacataccaggcactaagggaagagaatggtgagtgatataaactagatctctatcctggaagtatttataatccagtggtagaaacagatataaactcaccaaaaacaagataagcagattgcttgtgatggatgccagctagaaaagagagactgactggatagacagcaatggggtggattcagagccctagaaaggaaggtcagggaatgatgctccgagaggagatacatgaagaaggcagccatttgaaagttcttcagagaagaagtttccaggcaaaaaaaaaaaaaaaaaagcaagcccagaaatcactctgacgttggaggcaaagccgggaagccagggtgggtggagagcagtgcatgaaaaaggcaggaagggtacaatagtgtgcaataggaagggggctggactttattgcaaattaattgagaacatgttaaagaatatcaagcaacatgcttgaaatttcatttttaaaagacctcttgaggtaaactgtggaaattgaactttacagaaacccaaacaactagttggagaatagcctcactttttatacattaaatcacataaaactccaataatgcaatgatggataaaaaaatccactgtctcacacaaaaaaaacaaaaaacaaaaaacaaacaaaaaaaaaaccacaaagaaaacaaaaccactccaaaggtatatatcatagagtgcaaaaatcccacattcaaagcagaggtgaattacttgtcaggatcccttagtgctgaaactgcatgtggagccctctttctttctttctttcctttctttctttctttggctttattaaagttttttttaaggaaaagaaaaaaaaccagatttatgcttcggaaaaaaattttggcatagattctaaacaaacacactaaagccatattctttaatcttcttagattcataaatgagctatttccttacttaagtacaattaggaatggcttattttctcaattttaagtgagtttctgaaacatatcacatgacacagaggatgggtggaaattagaaactgttgctgctgtgatagttcatgaatcatatgatcttgcttttcctccataatttgctaatagcgtctgaaatctaagaccaccgcaaggaattaacatataattcaatcagagttaaaaggatattacccaagttagcgctgtcggtttccagcatgcaagtggtgacaaattaggaaatcttttttttatttatttatttatttatttatttatttatcattcttttgtatatttaagattgtcctctctaaacatttggatatccatgtaacactgcctttaggataaaaataagatggggagggggtctggagttgtttgcagatattttaacacatgcttgaagtaaatatgtagaaaaataaatgtttttacacatgtataaattattccacccccagagagtcactgctcttaggtagccacaggagatggatcttttgcatgtaaacgcagttggttcccttctatgaaaggctctctggctttctctttgtttccccttcagactttgtgggggccactgtggggacatcttaagtcatgcatttcctaggctaattattccagcgaactaagcctgctgggcattaaggctgtggtttgtgctattactactctaagatcaacgttctctcctatttcattacgttcaaggtcactaaggaaagattttaaacccaaagcggtgcctccagagccctgggggttcagacaaggcattgcttctcctagtatcacctacatcctagcagcctctcattattgcaagttgttttgtggaattctgtaaacgaggctaatttctcacaatgttaataaaacagatatttacctaaccacatttttagagcagaggtgaagggacacaatcggtgtagaaattgttgcaagagatcataaggtcagacatcatataccttccaggcattcctggcgcctttccttcctcctcccgcgtaactcttcccagcacaaaatttccctttctcagatcagaaaggaaaagtacacaccctcttcgcttcctaccccccttctgccttttccccacagctgttcttgttgcattttcatttctctgttctggtccatcgatcctaaaggctttggagtcctgcccacccaaaccgggtatactctcttcatgggttcagaagttctccttcttcctcaactaccagcttcaagttgtcactacttttctcactttccttttttgaaaaccagctttactgtgttcatgatcatttctgagacgtcttattaaaaaaaatagccctccccacacttcctttttttttaaagcttgcattccagctggctaggagaagaaaggtccctgtcgagctgggagtcgaggttttattcatttcccctccattacaggaacgcttctccctcaatcctcactgttagtagaaattctgcttagtttctcaatcaagcctgcatttcactcatctcagtcttctctagcttctctcctcactccccgagcatgctatgtaaagttgtatgtgtcatacttatcccaattattaaagaaaaaggacgcttaactaccatcgattgaattcccagtgtaagtgtcctttcctccctaaaagtaacctcgaattcttctcttaggctgagtgatcctgggagaaatgaaatatgtaacattcttaagtataggcagctacatgcaaacaaccacacacattcttcttcaaatactttggtgagatgattcctattctttaaagaaaggcacttccaaggatacagttatgaacattttgtcttttatgtctttccacagttacaacattttcactaagataagcagcttttcaatgaatttgatcctttcctgaagtaattgttcaaaatgtctctaatcaccaccctaactaggtttcctttggggactggggctagcactgctcatctcagattgtgaacgtctatcctaaacccatgcagcattcttatcctattgtgatgaaatccacagggttcaaaagttaattcttccatgaatgtgtaccaggtgctggggaaggctgggaaggagaggctgggtggtacagatgacagagttcctgagggtctagttgagcaaagatatattgaatacaaaaccaaaaataacagcatgaagtcaatggaataatagtgtgaagtgctcaagggagcccagaagagaaaactgtcccataatggaaagaggagggtaaaaggaagggagtttcacagcagacaaggagaaggggcatttttggctgaggaaacagccttgaaatgtaggctatacttagagaccatttagcagtctggcgtggctaggggggaaatttgataattccatggggaatgagacagacacagaatgtctaccccaaatcctaccatctgggggcctagaatccttctttgcttcatgtcagtaaggccaagaaaagtacttttaaagaagaattttaaaagatttgcatggctagtgaaatctttgggattgtaggaagaaatcacaataataattaaaattattataactattattttgtcaaactccaagtgatttaagacatacatagtattttatagctgaaggaacttcaaagaccatttcatccagcctgcttattttacagatgaggaaattgaggcccagagaaaagttccttgctgcaaatccactgctagttgggaacaaagctaggctggagcacagatctcttgcttcctaagccagatcgcttgccacgaaaatgtgccaatctgtgcacccccactaccgatttgtcctgtttctcagagaagaaaaaacaatggttagagtttaagaggtttccctgaagtcacccaactcctggtggctcagatgggactcaaacccgggatgttggggacatgtagccaacactctcctgtaaacattcttactaaaactaaacccattcacgagggatgaagtgtgagacagaagagtgagtgtggtgattagagccccccaacccacgtatctccagtcatgacctgagtaagaaatacaggggctgaaagaggtctgctttgcctcagctaccaccagcctaaccacgcacggctaagcctcaaggagttctccttcttcactaagggcttagctgcaatgtggtttaaattagacatttcttgcctgagtagaacaaatcacttaggttatacgctgacaaaaaaggaacagtctgcatgcttggaaagcttagggggaattaaattatgtgctgtcacttcagagttgttcctctgtcctgtacaccaccacctctcaattgcctgcaggagctgcagggccttgcgtgcaagctgtgccataacccaaggcttaacataaacttcgggctctcaggtcattgggaaataacaggtatatccggttgtgccttttgtgcttgtctgcacgcaaattaaaagctcgtgctatgctgaactccttggagcctctggttacagagaagggaggatgccttagaatggaattttcacacaattgtcctgtttgtttttccagggaattgggtgatagtgtgtgtttgtaagaagttcacacctctgggaggctgagctcagaaggggcgggatgtggaggtggccatgtgccaggcgaccctctagggagcagggctccaaaggaccccacgtctgaactttgaagggacggtagtgcttacgggggcggcggggaagggcggggtttgcgcagatctcagacttcctggctagtagcaacaatgccaagtgcagagctaggtggggaggggtgcaggaagggatctgaaagcttgggggccatgtactcaggctgtcacctccctaagggaggctcctcacctccctaagttttgtgatgcccccactacagttcagccctgaaccctccagatggctgattggagtaggaatgaagcgtccactccgtcttcatgtttcttcccatgggacacaataatattcccttcgctgtgactacagcctccccccagttaagtaggagaaatctatgcctactgcactccaactgtgagatttcctctggcaggagtttgcctagctggtgcagctgggaagcagcagagagtttttgcagcccggcggaactgaattcaaatttcagctcaaccaacatagtgtgtgtgaccttgattgataattccaactcttcctgccttgctttatttgtctgtaaaaaagggatgagggcaatggttatctcaaagggttggctgtgtgggattaatgaaatgatttctgtcaagtgcttggcacattgcctggctcaaaatgctccatatatggcagttcttacatatatgacagtacattattattgttaccattggtttaattggcagagctgcgatccaaaaatttcagactgtggctcgatcctgggcttcgatttcaggctgtggctaagaagccctcctggcttcacacctaaccaggatccacatgcctcttccactgagctgggctctcccagcttcctgactcaggcactacctcgtctccgggccgcaggggtttgggcatcattctgtctgcctcttcttcctcctccttcctggggctaaggtacatcatctgggcaggtagctgtcttgggaagatgacatctttctagccagacacctggtggtggcaactctgcaatagtttagagggttgcagtggtgtttcaatgcgcccacacttgtctcagggctattctcttaaaatcagtaactgggacattattttttctgaaatccaccgcaccctcacctacttcctacgccaagacaatagcccatttagatttttcttggatgaagagacattcacacacacacacacacacacacacacacacacacacacaaacaaaaaacacacttttttttttttttttgagacggagtctggctctttcgcccaggccggactgcagtggcgctctctcggctcactgcaagctccgcctccggggttcacgccattctcctgcctcagcctcctgagtagctgggattacaggcgcccgccacaacaccaggctaattttttgtattttttagtagagacggggtttcaccgtgttagccaagatggtctcgatctcctgacctcgtgatccacccgcctcggcctcccaaagtgctgggattacaggcgtgagccaccgcgcccggcccaaaaaacacactcttaagtttagacaatggttctcaaagtgtggtccaggcaccccgtcgggatggcccctgagaccctttccaggaaacccacaaggttacagctgtgggaataaaacattatttgcatttctaactctcattctcttacaaatttactggggggtctttctgcagaaacagatgtgagtcacctgctatcttctgttaagtcataaattaaagagatttgtaacaatattttttaaaactgcccactctgactaaatatttgtaattttggaaactagttattttccataaaatgttatttatgttaacatgtattaggtttattatttttaatgaactaacaaatattttataagtttttcagctttaatttctagaattataaatattgatagatacttagctaaacaatagttctttggactctacaatattttttaagactttgaagaggttctgaaaacaaaacatttgagaaacattgagctaagattttggcactggggcctatgaaatcattgcttttgctcacttacttctaaataaaaccatcatttctgaggattggaatagtgtgaattttatggtaatttcaatataatgggtttgagtgtagcagatctagtcatgaagcccatgtggaggctgcatgccaactctctgcatgttccagccactgtgttaaaggaagattttctaagccatcccaagatttgattgtaaattgtggagattaaattgctgggcagataccaaggatattctgcaaggggaggggaggaagagggtgtgagttgcatcaggctctggcaacaagatggctttgcttgttgtggtcttgggctcctggagggagtcagctcacagggcaggagaaggcagtggggtggcccaggtccctaataggcataacagtactagagacctctacagttactgtagttagaggggtggggcttctgtaagacttaggatgatacgcagtgagtcaacaaatgtgtactggtgtggtatagatgggctttggtgcctgcagacctgaattcaaatcctgacccctctcacttgcaacctctgtgacatttggcaaatagtttactgtctctgagccttaatccctttgtatataaagcaggctaaatataccaatatttttaggatgattgggagaaataaatgaaactgtcaatgtaaaaaatagaaaacagtgcctggcacttagggggaaatattagctactttctctgtctccaaacttgttgtgtggtgtgggagactctaagggaacggaggagcttaagccacaggccctggccttatgatgataacatcagagagaatgctcctcacatttagcaggacacagtgctccgactgtggtactcaaaattgttgtggtgtttattccttgttgagtgatatgtgttactcaggaggctgaggcaggaggatcccttgaacccaggagttcaagaccagcctgggcaacatagagagaccctgtctcaaaaaaaaaaaaaaaaaaaaaaaagatacgtgtaagttgctcttcacctctctgatttgctgcaggaagcctcaggtattaggttcagagtccagagtaaatgagggcagaaatggaggttcccaccagccctgagtgccttctgtgcacttgctgtggaagaggattccattttaccccgtagctcccgggattccactggggtgtggctggtaacctgggggctcagggctcagtcacatccttattgcaccagaaagtccctgaaatagtgtaggagaatgaggtgcctgggggcatggctgctggttggaggccacagtgccaccttctcaaggctcagaaactgggaagccttccttccttctgcattcaaacccttaaaatgcacaacccaccccccgtggctgactcagcacaatgggaaaaggaaaaacggaggttagtcagcccaagagtacagaccattgaatctaactttccattttggactggagagcattcgagacaatttcctccctggcctttagtaagggagagctgggagtctcccgttctgccttctggtacaggctccagaagtaggctgtttccctcattgtggctgtcaaatgggctgtatgccccaggtctgaggccacagtacactttgactcagagctgtaatgtaagaaaaaaaggcggtgttttctgggaagctggatagcgttgcgtcatttgtacaaatcaccaccgggaggtcccacgacagcactcccttgagtttcctcccaattgcactgcacagcatggagttttctgaactctcctcagcagggaattgcatgagtgttgtcctggagcctcattgccacagggctacaaagcatccgtaacagtcacagagggactgaccgaaagcatagcttggtggaagaggcctactatggcctcatcaggctcttttgggaacatggcatccccctgcctaaagaactgtctctgtactacctaagggtcctgatgtggagcgcgtctgggtgaggagaaattagatgaggagaaagtgctgcagagctgccatctgggagttggagggaaacacaaattggctattggtgctgagctcttctgccaacagcagatgtttctgtgagatcagccttcttaaggcagcggcaaatggcctcccacagaataatgataacagctaatgatgcctgagcacccaccacatgccaggcacccttctaaaagctttacatgtattagttcattcagtcctcaccacaactctgcataatcggtactggtatcgtctccattttacatctccattcacttaagtgtaagctggacccagagaagcgatttctagcatggaagtcactccggtgtaagtaggagagccagattcagattcagtctggctctggagtgatgctagcagccactcaatgtgctgcctgagaaacgcaaggaggaagtgactggtgccactttgggctgttaggaatttgcaggtgggtaacggcacgccaccctgagagctgtcacgctgaaccaagtgggccatgtttttattcctgcgaggttcaagtccttgccatgtcttggattttactggacagaagtaaggacttagtaagtagtagtaataatgataatggctaactgttattgggtgctcactctgccatcaactatgctatttgttttcttacaatcaatatctcatttaatcctcaaaaccaccctctgtggttggtatattacctgtcttgtacaagtgaggaaagtcaggctcagaagggttaaataacatggccaaggttacagcttataaataagagagctggtgctcacacccaagagtgcccggtcccagaagccaaactcctaatgattgggtatgctggctgtattgcctttgatatcctctggaggattagacaagcccagaaggcatttgggcctgcgcccacggcctgtaaagaattgccattcatctaagaggggatatggaggtgtgtggagttggctctccaatcctggcttctgtgatgtgttccatagggatgtggaggtccggaatcacccccgtctaatgttttatcagctttcatctggggatttccctcatttgtcaggaagaggagataatctgaacacaggcatatgtattctttaagagaagaaataggtctgaaagacaagtaaaatttttgttttgtttgttttgttccatgttggcaaacctaagtcaaagtaaccatcctttatagaaggaaaagtatttaggtacattctacttggtacaaagccaaggttcatagagatgggaattggcaaacctttttagaagacagtgaggatgtagcatatatgcatatatccctatggctcaagcatttctattgagaatcgatactgggggaacatttgcaaatggattcagaattgcacagaaaagtgaaatcactgcagtggagtctctaataatagagttgagaacaacacaaatgaccatctaagtcgccgttgatggttgaaaaaataatgttggccaggcgcagtggctcacgcctataatcccagcactttggaggctgaggtgggaagatggcttgagtccaggagttcgagacaagcctggacaacatagcaaaaccccacctctaaaaaatactcaaaaattagccaggcatgctgccacgagcctgtggtcccagctacttggaagcctgaggcaggaggattgcttgagcctgggaggtggaggttgcagtgagccaagatcacaccactgcattccagcctgggtgacagagcaagaccctgtctcaataataatagtaatgacaataataatgtcatggtcataccatgcagtagtttaaaatcatgaagtagatctatctatctatctatatgtacaaccgtatgcatgtacataaatagaaggcacatggtacccatggttactctgggaaggggtgggagtgtgagttttctcattttattctcatttttctgcatatttttatatactgattgactctcttgcaacaagaatctatgttactacgtgtgtgtgttttaagaataaatatctggccaaaatagaaaaataatttaatatgcataatattctggatgtataatgatgcaactatataacataaaccgcagtccaaagatttttgcctagaagtagtccagactgggccatgctttccctggatagtcttcctgtcctgtcctagtctgtgctcctgggagtatcaacatggcctctgtaggccagaacaccatcctaaagccacaagatgcatttaatagaaataaatgtaaaatctcacatgtagtatttttttgaaaaatcaataatacaagtacaactgaagactcagccagctaccaagtcctatattaaaggatgaagatttttgcttatcacaatcttagtagaatatagatgttttaatagtgggatgcaaatatattaaaacagggcaaaaactttgtttgcattgaaagtaacactatgtctaatgggaagtaaccacacccccctgggctagacagaatgtcatatttgggatactatgttcagtttcaggcccatactcagatggacatactgaaaaagcacattgtccagaaggcagagataaggaactggggcatttttaattggtggaaggatggctcagaagcagcacaattccatcttcaaacatgtgacagcaaaggagaatgagtcttgctttatgtcactccaaagaatagctctagatttaccagaaggcaagaaagttcactccagaatttttcttaatattgggaagaaccttctagcatctacagctttctaaccaaagcagtccaacaatagaacagacaacagttgagaaatgatcacttcaatagtagaagggaaaaatcctgttgggagtcaatggtcaaaaaagctgacgtataactatccagcctttgtgttctccgttgggatcatgcaggggaggactaaccacttaagttatttaactatcaattattttctcaaaccctggatacacccagagttttcaaccggaattttggtccatttgtggaaagagaaaaaaacctgtgagggaatgcagatctaatgctaaaaactaagaggtgaatggagagagagagagggagagagagagagagggagagagggagagagggagagagggagagagggagagagggagagagagagagagagagagagagagagagagagagagagacagacagacagacagacagacagacagacagacagacagagagagaaagaaagactagaatctggatgctaaccatccaaaaacctggaggctgtaccagtcaacatgtccatggctagatgttgtgatcttagctgagcccaaatgtacattcttttggtggtggggtgttttacttgttgctttatgtattttcttggtaacctggtaaatatttatttttagaaaatgaaaataaaaaggaaaactagtatcctttatctgcctaaaggttttctatggttggtcaaagaattagggaagtaaagtgtttccctattgaccaaagttgtggacagtaggctccctctttcactgttagaaaagttgatttcaggctgggcgcagtggctcatggttgtaatcccagcactttgggaggccgaggcaggtggatcacctgatgtcaggagtttgagaccagcctggccaacatggtgaaaccctgcctttactaaaaatacaaaaattagccaggcatggtggtgcacccctgtagtcccagctactggggaggctgaggcaggtgaatcgcttgaacatggcaggtggaggctacagtgagtcgagatggtgccactgcactccagcctgggcaacagagcaagactctgaaaaaaaaagaaagaagaaggagaaggaaaaggaggagagaaaagtctatttcaggaagtagagtaggtggtagtagaagctcagagaacaaacgtacaaaaacaaccacagaccctggcgtcccttcccttcgtatggaatcatcactgtgccaagtcggtgggagcttcaccccacaaatattaagcagcagaggcacatgctcaaacgttgagcaggagaggtaagtacaccagttgagagcccagacaaagtgactgaccaccgtgactatcttttagccccagggctgggtatttttttctttttctttttcttagttgctgtatctctctgctcccccttcttatttccctcactcttttcccctctgccctgactctttactcttctgtgtgagagagaatgaagagaggaagggagacagcagaacagaaaagggggcacctgagacgagagtggaggtcttgagggaatgagggtgaggaagataggagtggacccagagaaagggaaaatgagagacagaatgagagagaagaaagaaggatgaagcaaggggaaggaaaagggcagaaggaagcaaaccaaaggaaagaactgggaatgatgctgggaaaaaccattaaagcacagcaccatttgctgcatttatgaagcacatagaaccctgagtagattatgccccttaacacaggggcacagtagaactaagggcatgacactgccttatatcatatttcttctgctttcaaaaggaattgaagaaagcctaagataaaagagacaagacacactcaagccattcaaagaacaaggacggcacagaaagtacaggttataatccatagtgctgaggagaaagactgcaattgagcacaaactttttattagtcctgaactccaggagtgacacatcagatgcaggaccctgaacagcagactaatcccactttctttccactgtccttgcttacaagaaaccctcaagagaagctaagaaggcaatgtaagatcaaaatgttgggaagatctttttttatgttcttatatttaacttttaattttgatataattacagaagagtttcaaggaatcacaaagaactcccatttacccagattctccaattaacattgaccacacttactttctcattctcctctctctccctctccttctccccaaacccctctattttttccttgagccatttgagggtaagtggcagacattacacccctttacctctaaatatgcattttggtgaggaactagaatacatgtagctttcactacatgtatttctgtcactttcactaataccagacagagctcatgggcaacgagattggaaggggagcaggagtaggaaacttgttttaagctgcaactacttagcaagtgactatcttttcttagattaatttaggtcaataaaaatagcagaatcttctaaatcaccttctcaccaactttacataggattgagaaaacatcaattgtctacatttgtctacatgaaataatattaatagaaatgaggattggtagccaatacccttggtgctaaccactccaagaaatctagaaagtgcttaatacaaagaaagaatccttgtcagcctgtattgttaggcccctgagcccaagctaagccatcatatcccctgtgacctgcacgcacacatccagatcgccggttcctgccttaactgatgacattccaccacaaaagaagtgaaaatggcctgttcctgccttaactgatgacattgtcttgtgaaattccttctcctggctcatcctggctcaaaagctcccccactgagtaccttgtgactcccactcctgcctgccagagaacaacccccctttttcctttacctacccaaatcatataaaacggccccacctgtctcccttggctgactctctttttggactcagcccgcctgcacccaggtgattaaaagctttattgctcacacaaagcctgtttgatggtctcttcacacggacatgcatgaaatttggtgccatgagtcggatcgggggacctcccttgggagggcaatcccctgtcctcctgttctttgctccatgagaaagatccacctacgacctcaggtcctcagaccgaccagcccaaggaacatctcaccaattttaaatcgggtaagcggcctcttcttactctcttctccaacctctctcactgtccttcaaccactttctcctttccactcttcaatctctcccttctcttaatttcaattcctttcattttctggtagagacaaaggagacacgttttatccgtggacccaaaactccggcgccggtcagggactgggaaggcagccttcccttggtgtttaatcattgcagggactgcaatgattattcacccaggtttcagaggtgtcagaccatgcagggacgcctgccttggtccttcacccttagcggcaagtcctgcttttctggggaaggggcaagtaccccaaccccttctctccgtgtctctaccccttctcctcctttctggggggcaagaaatccccaaccccttctccttcaccctgagcggcaagtcctgcttttctagaggaggggcaagtaccccaacctcgtatctctgcaccccaatcccttatttccgtgccccgacctcttatctctgcgcccaatctcttatttccgcgccccaacctcttatatctctgtgccccaatcccttatttccacaccccaacctctaatctctgtgcccccatcccttatttccgtgccccaacctcttctccgtgccccaacccctttcccgcttttctggaaggtaagaacccccaaaccccttccctccatgtctctactctctcttttctctaagcttgcttccttcactatgggcaactttccaccctccattcctccttcttctcccttagcctgtgtcctcaaaaacttaaaacctcttcaactctcacctaaattaaaatctaagcatcttattttcttctgcaatgccgcttgaccccaatacaaactcaacagtagttccaaatagccggaaaacggcactttcaatttttccatcctacaagatctaaataattcttgttgtaaaatgggcaaatggtctgaggtgcctgacatccaggcattcttttacacatcggtccctctctagtctctgttcccaatgcaactcatcccaaatcttccttctttccctcccacctgtcccctcagtcccaaccccaagcgtcgctgaggctttctaatcttccttttctacggacccatctgacctctccccacctccccaggctgctcctcgccaggcccagctaggtcccaattcttcctcagcctccgctcctccaccctataatccttttatcacctcccctcctcacacctggtctgccttacagtttcgtttcgtgactagccctcccccacctgcccagcaattgactcttaaaaaggtggctggagctaaaggcacagtcaaggttaatgctcctttttctttatcccaaatcagatagcgttttcatcaaacataaaaacccagcccagttcgtgactcctttggcagcagccctgagacgctttacagccctagaccctaaaaggtcaaaaggccgtcttattctcaatatacattttattacccaatctgctcccgacattaaataaaactccaaaaattagaatctggcactcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcggccaggcgttcctccagaacctcctcccctaggagcttgctacaagtgctagaaatctggccaccaggccaaggaatgcctgcagcccaggattcctcctaagccatgtcccatctgtgtgggaccccactggaaatcggactgtccaactcacctggcagccactcccagagcccctggaactctggcccaaggctctctgactgcttcccagatcttcttggcttagcggctgaagactgatgctgcccgactgccttggaagccccctagaccatcacagacgccgagcttcgcgtaactctcacagtggaaagtaagtccgtccccttcttaatcaatacggaggctacccactctacattaccttcttttcaagggcctgtttcccttgcctccataactgttgtgggtattgacagccaggcttctaaacctcttaaaactccccaactctggtggcaacttagacaatactcttttaagcactcattttagttatccacacctgcccagttcccttattagggcgagccactttaactaaattatctgcttccctgactattcctggattacagctacatctcattgctgcccttcttcccagtccaaagcctcctttgcgtcctcctcttatattcccccaccttaacccacaaatataagatacctctactccctccttggtgaccgatcatgcatcccttaccatctcattaaaacctaaccacctttaccccgattaatgccaatatcccatcccacagcatgctttgaaagggttaaagcctgttatcacttgcctgctacagcatggccttttaaagcctataaactctccttaccattcccccattttacctgtcctaaaaccaagcaagccttacaagttagttcaggatctatgccttatcaaccaaattgttttgcctatccaccccatggtgccaaacccatatactctcctatcctcaatacctccctccacaatccattattctgttttggatctcaaacatgctttctttactattcctttgaacccgtcatcccagcctctctttgctttcacttggactgaccctgacacccattaggctcagcaaattacctgggctgtactgccgcaaggcttcacagacagcccccattacttcagtcaagcccaaatttcatcctcatctgttacctatctcagcataattctcataaaaacacacgtgctttccctgctgatcgtgtccgattaatctcccaaacctcaatcccttacaaaacaacaacgcctttccttcctaggcatggttagtgcggtcagaattcttacacaagagccaggaccgcaccctgtagccttcctatgcaaacaacttgaccttactgttttagcctagccctcatgtctccatgcagcggctgctgccgccctaatacttttagaggccctaaaaatcacaaactatgctcaactcactctctacatttctcataacttccaaaatctattttcttcctcacacctgacgcatatactttctgctccccggctccttcagctgtactcagtctttgttaagtcccacaattactattgttcctggcccggacttcaatccggcctcccacattattcctgataccacacctgacccccatgactgtatctctctgatccacctgacattcaccccatttccccatatttccttctttcctgttcctcaccctgatcacgcttgatttattgatggcagttccaccaggcctaatcgccacacaccagcaaaggcaggctatgctatagtacaagccactagcccgcctcttagaacctctcatttcctttctatcatggaaatctatcctcaaggaaataacttctcagtgttccatctgctattctactactcctcagggattattcaggccccttccttccctacacatcaagcttgaggatttgcccccacccaggactggcaaattagctttactcaacatgtcccaagtcaggaaactaaaatacctcttagtctaaatagacactttcactggataggtagaggcctttcctatagggtctgagaaggccaccgcagtcatttcttcccttctgtcagacataattcctcagtttagccttcccacctctatacagtctgataacagaccagcctttattagtcaaatcagccaagcagtttttcaggctcttagtattcagtgaaatctttatatcccttatggtcctccgtcttcaggaaaagtagaacggactaaaggtcttttaaaaacacacctcaccaagctcagctaccaacttaaaaaggactggacaatacttttacgactttcctttctcagaagtcagacctgtcctcagaatgctacaaggtacagcccatttgagctcctgtatagacgctcctttttattaggccccagtctcattccagacaccagaccaacttagactgtgccccaaaaaaacttatcatccctattatcttctgtctagtcatactcctattcaccgttctcaactactcatacacgccctgctcttatttacactgccggtttacgctgtttctccaagccatcacagctgatatctcctggtgctatccccaaactgccactcttaactcttgaagtaaataaataatctttgctggcaggactgtgctgaatctccttaggcactctctaatcagatgtcctgagttgtcccaattcttagaccttttatacctgtttttctccttctcttattccatttagtttttcaattcatacaaaactgtatccaggccatcaccaataattctaaatgacaaatgttccttctaacaaccccacaatatcaccccttaccacaaaatcttccttcagcttaatctctcccactctaggttcccacaccgcccctaatcccgctgaagcagccctgagaaacatcgcccattatctctccataccacccccaaaaattttcgctgtcccaaaactttaccactatttagttttatttttcttattaatataagaagacaggaatgtcagccctctgagcccaagcaaagccatcatatcccctgtgacctgcacgtacacatccagatcgccggttcctgccttaactgatgacattccaccacaaaagaagtgaaaatggcctgttcctgccttaactgatgacattttcttgtgaaattccttctcctggctcatcctggctcaaaagctcccccattgagtaccttgtgacccccactcctgcccgccagagaacaacccccctttttcctttaccttcccaaatcctataaaaccgccccacccctgtctcccttggctgactttcttttcagactcagcccacctgcacccaggtgattaaaagctttattgctcacacaaagcctgtttggtggtctcttcacacggacgcgcatgaaatgtataatgctttgtcagctccaaatcataccctcaactttccattttacatctccgaaatctggatgtatcttagagtcgatgatgcaattataattggtagcttcctttctttatgttagtacataaaaataagggtgcatcctacaaatgatggcttctgagattagataaaatacctttctattagctctgtggttctctgcctgtgtattgccaggaggaaggaagtggagcatttcaggtgaggcacagggttttggtatcaattcctaagattcctttcatggtccagcccctggtgtgcattatcctacagttcctccctctatcgcaccctcagccacttggtgtgtctccttatttctgctcctcttgcctaccagcatgtgcctgatgactgaatcctgcccacccaaatgtcaagagcctaccagagatggcttattctcctccactctcctcagtgcatgtgggtatgtgtgtttggagatgactggaaaagcacagtggctacccattaaactgacttaggggtcacactagagaggaagaccatgaagaaaactgagttccagcctgacagcagaagggcagagctttctgggctactggctctaagggcaatgcatatatctgctgatttaaaataataataacaataatggctttgggtttccttaggttatcctccaacccaaagaaaccagtgggcagacatgtatacatggagtggactgggtcagctctttggcttcctagcatgttctgccatctctttttttctgatgacagaacaagcccttgcccacagggtaaaaacctgatgccagcctggccccctggagtccttctaggaccctggaagagagctgttctctttctctttgttttgttaattttaagctgcttccttgccatgcaaagagagaaagcccaagcaaagaccagcataggcagagagccggtagagcggcctgggtccttgtatcctgtgaagcatcacggttatccttctctgcacatgggccagtgcattcctgttctgcttaaacaagcttaagttgttccttcgagtcaatacaagataagatattttaaacctctctctactttaaactatccctctagcttagctgttctttttgaaagttatttgcaacaaacaattcaagtttgagatttgggagggcagaatgcccatattctgtgttgattgaaaggagattcctgggccttaggtccctgctttggttgagaagttgtgatgataattaaagagcctgcgtagattctcactagaggcagggctctgccttgagttgggtcggggtgccaacaggctgctctggatttatccgaagtccttatcagggtaccggatggggcattcaatgaagtttgcaccataaagccctaagaactccaggcttgaagattctctgcaaaaagtgttaccatagccagtcattttggtttgccataaccgataagggcttatctttctgacagcacttaccaacctagttcctctgatttttgagtcatgtcctagaaaaagagctgagcccaaggaactacagcttggaggatatatctgatctatctgcgatggcaggaaagcatgcatctagttgatctaaaaactagatggcattattgaggagttggacaggcggtcttaggaacaacctcgttttatactttttaaaaataggaatttacttaaaggcaacttccatctgctctcattctggcagaggtattgtgataaaggctttcaggaatgtcaacagctcaggattggcattagctcatagataattcccgtctactaaattaaagtctatgagagattgatgcatgcaccagagtcttgaattattaggcaaggatcttgctaaagctggacatgggaaggttgctatgaaactcatttcaaaggctgtgtaggccaactcacctctgggaaaccaacgcttattattaaaccaatgcaactgctcaaaaactaaaactccatcactatctaagttccccatcatggtgtgtgaaatcatttccagaaaactcttcaaaagataccgaataaaaggcatcacaggccgggcacggtggctcatgcctgtaatcccagcactttgggaggcccaggctggtggatcacctgaggtcaggagtttgagaccagcctggccagcatggtgaaaccccatctctactagaaaaatacaaaaattagccgggtgtggtggtgcgcacctgtaatcccagctacttgggaggctgagccaggagaacctggcaggcggaggttgcagtgagccgagatcacgccattgcactgcagcccaggtgacagagtgagactccatctcaaaaaaaataaataaataaaaataaaaataaaaaaagccatcacgaaaagacatttctttatcaggtcagcaaattgattgctggtttcaatctctcaagaagtcagattcttttcagacactcctttgtgtttctttacaatgtaatcagtcattccagggtcagctatgaggcacactcccctggcctccctcataagcaatttaattgcaaagggttagcatactatttcttctctgctattctcagaattctcaattatgaaaacaaaaacaataattaaaaagttcttccagctgattttttttttttttttttttttgagacagagtctcacttaaactctgctgcccaggctgtagtgcagtggtgcaatctctgctcactgcaacctctgcctcccacgttcaaccaattctgctgccttcccccctgatccccgagtagctgggattacaggtgtgcaccaccacgtccggctaacttttgtatttttagtagatggggtttcgccatgttggccaggctggtctcgaactcctgacctcaagtgatccgcccgcttaagcctcccaaagtgctgggattacaggcgtgagccactgcgcctagccccacgtgcatttttttttttaagggaggcaggaaagaaggcatttgggcctcttatctgcaattttcttccgtgtaaacttatgtgaaggatctggagtgggacttggtggcttcaagccctggctccacttcttgatggctgcgcgacctgggttaagtcacgcaacctctctgaaccctagtttattcatctgtaaacaggtcaataatagcacgagattcgcagcgcgagtggagctcaaagtgcagggttgtccctggtgaacctatcacttttatatttatcctttgatgaagccagtacaattcctacctggttaaccagatacatcccacctcttccctcgagttcgcccttccccccgcctcgtgaagtccttgttctcttagctgtcttgaaaatcctatgcatcagcatgtaggaaagggcgcgccaggcgggggaagccacccccgcccaagcgcctccggcttcccttataaagggagggcccccttcgcgaccgcaagcgcgcccaggaagaccacagagccgccggtgcgcagcgaggtggcgatacgcgcccgggctcggcctgcgggtggtggcccaagcgtccgcctcgctggcctggcaggcgcgactgtgcgtgcgcagccgagggtggtggcggccggcaccccacgccaagggtggtggtggccggcaccccaccctcggccgccgcctccgcgtgtcaggtgccgtgagaagcgcgggaggagcggccgcaggcagcgcccagggatatgactggagccgactttccagaagcggcgcacgcaaagcccagctccgcacgcaaaggggaggcgacagcagaaacttcaacccgataaagttcgccggagcgcggagattcgcctcctcctgccactctccgccccgctcgggtcccgccccgctagctcccccaggcccccccagtcgccccagcttggctccccgccctgcgccaacggcttccatcgcagcctgggcggccccgcgcccaccagcgggcggcgccacctggagtggcctctacgcgggaaatctcagggccagctgcgccccaggagcctttgtgtgcccaagcactgtcggggccccggggcgggggagcggctacttttagggattcctgatctcgccgcaagaactggaaaaaatttagcatgccaaagagcctccactgaggtggcaatttgtttgcgagaacctaagataaaatttaaacaaccaaccaggggcgctgtgaggcaaaccgctgccactacactggctttccgggaagcaagctcaagtcgcggagagggaagggaggtcgtgcgctcggggcggggcgcgctcccaagtcgagcgcagcggccggggcaggttgtaccgagcgtggttctggggacaccgtgcggcctcgattggaggtggctgtgatgaagcgcggttaccgcacaatggaaacgtgggcacctccgctcccatgaaagcctgctggtagagctccgaggccggccggtgcgcctggacgggagtccgggtcaaagcggcctggtgtgcggcgcgccccgccccccgcaggccccgccctgccaggtcgcgctgccctccttctacccagtccttaaaacccggaggagcgggatggcgcgctttgactctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggctgcgggttcctgttgacgtcttgccctaggcaaaggtcccagttccttctcggagccggctgtcccgcgccactggaaaccgcacctccccgcaggtcagtctgtctgccgaggcgctgcccggcgacctcttcagatggattattacaggtagcgggtggcgtggtaggtactttaaaggaaatcaagcgccaccgcctcgatgcccgcagcgttgtccccagattgcaggaaccgttacgcgccttgcggggaggggaagggtttggcgctgggttacagcgaggtggaaacacgccccttctcttctccaagggagagtgggttggggatgggaaggggcgtcttcggccatttctccagagagtcagctccgacctctccacccaacggcactcagtccccagaggctggggtaggggcgtggggcgcccgctcctgtctctgcacccctgagtgtcacgccttctcctctctgtccccagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtaaagcctctgggaggcgtgggccaggtcttttctcctctgaaaaaggcggagtagagacagaatatgctgagtttgcaagcagggccccgggtttggggtttcgctccaggtccccacccctcaaaaccaagatcgcgtcggtaaagggactcacagtgagggctgcgacacgcgcacgcgccccacccagcggtgccccgacccctccggtctcctatcttgtctctatcgtcccctcccctgcttgcgagtgagaacacatttgcaaagacccctccaccccccggaaaaacaagagtttttaaatgcttggagatgagccctgatatctctctccctggcgcattacaatcagaactggaatagttccgaaagaaaaggtaatgtcataaatatgttaaacacagcagcctctcctaggctagtcctcggcgtgcatccgaggccgcccagccctggcgctaaaagcgggccgcccgtcagggctttgttccaggccaaggaagcccatggaggccgggccagccgacaggtaacccgcacagaaactttcagaaggcggccacaactagcgggcagcgctaggtttataaaacctccgcgctaggagtttgagaaatgccggggtagaagacaagaagcagtcacttttacgaaagcagagtagcattcagaaaggcagatgggatatccaggaggcgcctgcagacgtttctggcccctgcgcttggctcagttagcggaccccctgatgcccacgttggtctctactaagcacggattcaacaggtccctggtgtcgggttgccagatttggcaaaagaaaagtaagttttacacgggaatactcacactaaaagattagcccttgttgatctgaaatccatatttaactgggcggcctgtagtatttactgtggaaacactatccctaggggcaaatgtttcgcaaggcaaattttgattgccgaagagaccagaaatcctggttttgtgtcatttcttggagcacaagtgagcagttggagatgctgaatctgcaggcgccacagaaaggtgtttggaaggcagagaatgactctttccttattaaaatccactgcaatctatatttccttagatactgtacagctaccttcacaaattaaaagtttctgtatacttaaaatggctttttagtattaaaatcatagaaacacccatggtgggtgagggagaggcagaaatcgaataaagaaaagtcaaccagagatcagggaaaaggaaatcccggaataggttccataggtttttgtgcatccgcagataggcattttaacttttgaaacggcctttgtttttcattagaaccacaatagttctccgagtactccaattaggcggcaaaaagaaataaaacaatttggaggtcactttcaattcaatatgctgatactttttttttcctttttagtgaaaagacgtatgacagggcttggcaaattacacgatctgtttttgtatatacgttttattgacgcagtcatgcccattcatttatacattgtcgatggctgcgttcactctacaacacaaggcagagcagagtagtgcaacaaagagggtttggtccacaaagtctaaaatagatactctctggctctccccaccatacatgtttctatgaaaaaagttggcagactcctgcaatataatgttgaagaagcgattctaaaaataactccacttcatcacatacgtgtatacattttttttcggagttgcaaacaatcagttacttgttttttgacttctaacactttgactcaaggtagtggacatttctaatcttttaatatttattttggtaatttttgatggctatatagtattttgctatgataatgtatagttatatataatcatttattgaactttaatgttggtcattggccttgattgcatttttaaaatttttattttaattttatgtatttacttaccttagagacagggtctcactaccttacccaggctggtcccaaactcctgggctcaagcagttctcccgccgctgtctggcaggtagctggggctacaggcgtgtaccaccatgcctggctaatttttagaattttaggtcctgttgtggttacatatttttgtatctcttaaattattttctgaaaatacatttctaggcatggattactgggtttaaaatgaggcgggaagaggttaccttcatgtctcttgcctcgtattaagattttgttttttaaaaagattgtatcagtttgtatcatcaacagtgaataagtactacagtttgtaccataattttatgaacattgggtatttgctttcaaatttaaaaaatacagtatgtagctttatccatcaggacaccaattatctttgtataaaatgagaacagcatgtctgttggaattgtccagggaaatgagggagaaaaaaaatttactttcacattgtaactttcgtgggccctgggtgcttttgcctttgtagattccttatactataaaaaaattaaaaattaaatttcatgactaccctgatataaagatgaatgcattaaaatgatgtatgaaaatattttcttctaactaaaagtgagtttttttaggtctgaagattgtaaaagacgtaaaaatattttcatgggcccctaaaaagtgttgtgagccctaggcactgtccctgcggtacccaatggaaaagtcagccttatctactattgtgctttttgaggctgggaaaacttaagagttttttgacttataatgggaaagacagcattagtcatgcaaggcctattacaggaaatataattcttaaagtccatcttgtaatttagtgagaaattaggaagctgttttagatttttttcccagaaatattaatttagtcactgagctagatagcctatttaagaaaaagtggaattaaaataaattataatgtgctttctagatgaaataagaattttgctcacttgcttttctctctccacattaaacaccaaacaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagcagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaa

SEQ ID NO: 229 - DNA, 12151 bp, Homo sapiens
agaactaagatccctaggcagctataacctaatgtcctctgtgttctatattaaatccctggttatgaccactccagaacgagggttgaaaaatgttggacctggtaacgagctaccctgtatcctcctccggctgtgtctccacttgttaacctacggtgtggtcctcctatcagagttcttcatcccatccttggcagagttctggcgacagctcctacctcttttcctcatgcctttcctctgtcagtaccaactgcaaagtcagtggtcccgtgatgtagccatcggattgaagcggccagctatcattgaagtcccacaacgtgagttaaggacatgtccatttaaaaatcgtgacctgccgttatcttctgggccctttatatatgaagaaatgccaatatttagcatattatgcctggataataaagtcagaactcacagttgcatattttagttataattcaggattaacaacagtgggacatatgtgtgtattacagggtaacatgtatgttatttgtgtgtgagggggcataaaaatgcccaaaagcagttagatatgtctttccctgctatatttttgtatacactttgttcaggtgatttttatcctcaaagtatttttttagggacacattacggataaccgttttcctctaaatttaaaaacctttggtcttctttgttaccggagcttaccatgatgtagtgactctgtcatgtgtcctattttctctcaacatttcatccctgaaagtggcactgaggcatggatatatctgtaacctcaaggttagagctttctccccagcacccttaattcccacggcagttcattagctatccagcagcagagtcccaccatggtcattagttaattttatttaccaacatatatctagctcctggcatgttatgtgggaaacagcagggatgccaaaacatggttgtgaaataaatgaaagataggagggagacaaacagagagtaaaagtgaataaaataaaaacaaaggtaatgtaagatctatgccaaggaagtggtatagttagtggaggttgaagttaaagtataccaggggccgggcattgtggctcacgcctgtaatcccagcactttgaaaggctgagatgggaggattgcttgagcctaggagtttgagaccagcttgggcaacacagtgagagcccatctctaaagaaataatttttttttaataaataaaaagaattccagggacttgtaatgctctgaaggcttccctaaggaggtggaattgctcccctaaatccatgtcaaggattcctcctctgtatcttcaggactcagtattcattcattcaacacagaactgagctagactcaggggctaggaaggaacctgtccttatatagctctcatgctagaaggaagatgcagaaactataaatgtacttgagtgtttatatataaaattgtactgaatgctatgaaggaaaaaacggacacgatctagactgggaggtcagaggaggcttccctaaggaaatagcatttgaactgagttctcagcatgactgagaattaagtaggcaccagtgttccagaaggaaggggtggtgagtctgtaaatcctcaggtggaggacatgtggagcccaaggggtgggctgggggaaatggtggaagatcagcttgcagaggtggccagaagcacgatcctagaggtcttagaggttcagtcattcgctcatcatggatcttggaaggcaatagcctgttgacttgtctgtatgggggacccttaaggcatagccagtgtctagcacttggtaggttcttagtagcattgaatgggtgatgtaagctttaaagggggaatgagttggatggtgtttttattttttaaattaaacctccctctcaccagtaccatggacatatttgggcacagttgttggtaaatgctcagctctgtgtatcacagagccatgcagagtaatgggcttcaaatcaacgtcttcataagggcttattaatgttggcccaaaatatgccatatgtatagaggagcaaaacacaatttacaccatccaaataaaggtcaggatgcaggtgaatgagcctaccatggaatctcaactgattcagttctgaaatctcctaaacttttgttgcgttggttatagagtgccggcagtgcaccttaagcagtgcctgcctgaactcctgttgcttgtatagtcctagtcattttgtgttttacttttcacctttggtccagtaacgtccatttcagcttctgatgtcactttcccttcagcctttggttcttttactatttcagggaatatttcatcttgttttggtgatagttagaagcagttgaaattaacctcacgatgtgttgaggattcagttgctagtaatggtaaccaacacatcggctcaagcaaaacagtatggattacaaggctgcaagtgtttctccaggaatcctaatctctgctggttttttttttccccctctttgctttgtttttgtctccctacagattggttttctatttcttgggccagtggtagaaaaaatgtggttccttcccagttcctctgtaaaagagaccattccttctcgttcagttctgaactcatgtttccaagagaaagaaactctagttcttttagggggttgagggaaaggatggacagaataattaggctcaaacatggccactagaggatgtgtcacacttgggagaagtcagtttgtgagaagggagggtggatcattttagttattggcagaaaatggaaccctcttcaggtagttcaggagacttttatgatgggactctagagcagtatggggggggtttcagggaaccaataagagatgttgaggagccccaagacaactactgggagtggctactgcccctattccaaaggggccaggggaggaaacagtattaccacatttcagtgatagctggaactgtggaggaagggctgcccaacataagtcatagtcttcgatagatgcaggcactatcagaaatgtggccactagattgggggtgaggggcaccctctgatctggtatcttccactggacaaacccaaccagaagccagcaaagggagtctaggtgatacaatttgagtcaacctggtgaacagatcccctctcccaggggagaacagagaatcaaaaaggtggattaaatcggtattttgataaataatttgattggtttctgttaggttctctttcagtctttgaaggctatatcccattcttattaggtacatattataatttttatttcattgaatatttacaacagttctgaaggtaaatgttatctctatagatgaggaactgagctcgggcaggttgagtcgcttgtcaaggtgacacagtaattgagtggtggcactgggatttaaatccagacctgtctgattgcaaagcccatacttgactctgaggccaccttcctgctgcagtgaaagtcatttcttccatttcctcagtagggatccagagatcaaggcaggagagaatctttgcttcctctacctccttttctttccccctttctctaaaagcttgtggggaaactggaagggaaagagaaagttctaattgacacctcccactccccagtttttctagagcttaaatagtatatggcatatactgctgtattgttttggttgcatttttcccacattgagtataagttcctttagaaccctatattgcatttctttgtatagcttttgtcttactagtatcataaacgatttactctgcccataccatgcagaacttggagcagacttcagaatttttagaatctaggatttatcctcttttctggcttactgggctagatgtgtgttttcctcatccatgagaagccattgctaacctccctcttagcccagggattctgaagccttgaagtgcattttactcacctacaaaatacagattctgaggctttaccccaacattctgaatcagactctctggggctggggcctgagaatggacattatcataaagtgttgggaaatttgggggcagccaccagacattggcccatgggtaagccactgaccagagataaagaaatctctgctctctcctgctgaagtcatatggtttcctgcctctttttgaatgaggctttggagtcagactgagcaggcaccttcaccatttacaataagtggttttacttgcataactgaacctgcttcccttgtgtaaaatggggacttatgcacctggaagtagaatggggttatgaggaatgatgagataagagatgtcaagcacttgggctgtggttaacacagaaaaaatgctggctccctttcaagtttgtttttccatcagaagtgtgactttgtcttaaaccatccacactagatccccagccttcatagtgacctcattaaagattcagcctgtggctcctgagaattaaacctcttttgatttgaaggaatcgggatttttcaattatctcaagaaaagggataggccaggtgcagtggctcacacctgtaatcccagccctttgggaggctgaggtgggaggatcaccagaggccaggagttggcatccagtctgggcaacatagcaacaccctatctctaaaaaaaattaggtgtgtggtggtgtgtgcctgtaggcctagctgcttgggaggctgaggccagaggatcgcttgagcccaggagttggagatttcactccagcctgggtgacagagagatactctgtctcttaaaagaaagaaaaagaaaaaagagaagggggatctgtggcaagagctggaaagtccccagacagctctgaggtaccgcctctcatgggctccgtggattatctcatggcctgtgtggctgtctgtctttatctctagtgacatctctgcttttctctgccaagatttatcccttctctgcagccacttgctgtccagcttcccttctttgtagaatctgcctctgcccaatacctttactttcgtgtggcctctctgggctcctccatatcatgacctgtcagctcctctttaactcctttcttctctcaagtgtttctcagatcagagaccagattgcaatgagagaatcagtttggtctggtagtatttcacgccaaaaagagttggtcaccctttggattatatgcctttggttcaggcacctacccctggtcctggctgttggggatggatggtgactgttatgtggcctttacagggctttaggcacaataaagctttcccaggttcagcctactgagtgctatggctatgacctggacattaaactggccctcataggttcagacctggccatggcaattgacgaaccctaccacagggctcttggaaccctgtgaaagccattttattgtatgttcttggctgttgaagggagttgtagcccagctgatggcttccatttcttttctgtggatcttgctttcatcataagcattgtttaggggtatagcatggaagagggagatcagggcctcagcctggttttcaactatgagattgagcagtcagtattcggttgctcagtctggccatgacagaattggagccagccctcaggactcttgatttttagctctctgccctttctgtttacagacccatggcacagaaagccttatgcccagacactgcaggatgcagagttatggagccatatcctttcagaggaatgcctggctactcaacagggttggaaagtcaaacaaggatcaacacctacttttgcctgctgtgtgatgggcccgagcctgcaaagctggaccaaatgtggcccctttcctaagggcggggggcagtcaccttctagtaggggaaggaatttagtctcacttctcctttaggaatctggagtattagacaagtcaaagcaagttaatgaggggttaacataacctcagaggaccactttgagtctaaagtccttccagatgtgtcagattggtagcgccaacttgtcagtttctattaagaagtaataggactgggcttcctgggtgtgagggaaagtaggtctgtgcttaaatgtccttccactctgtcacaaacaggagattgaaacttaggtgcctccattcttatctgtaacctctctcagggttgtttttgaggatgcagtgagttaatgcatgcccccagaagcaggggaagggaactgctttggggggactcctatgtgttacactgaaggactcctttaaatgctttatgacgtttctgttctcttgtaactctgtaaggtcggggttatccctgctttctagatgaagaaacaggcttagagctatttaggtcaaggtcacaaaactggcatgtgacaacagagatttaagtataatttggaaggtggctgtttccaccacaccacaccctactggtagggttgttgtgatcacatgggtaacagctgtgaaagtcaccaagagctttcctggcatccagaagcccttgatctagaggcacatcagtctcctctgctgagaaggaggggacaccactccatgctgttgacatctcttgagttttaaaatggagcttttacttcagggtaactcctatttaagtgttcacacatggattaattcctttgctcgtgactgctgcagataaataaaaactgtggtagggcaccaggccctgagctaggccaggcaggtttggacaatttcctaagccttttataaggaaaactgggtttaaaaaaaaaagttgccctgggtacagtgattcatggactggttaggttggtttttttggtttgttttcctcctatcctttttttatatggaaaaaaattatgcatgcttggaaaggaaaatttgtagcttttcatttatcttttacttatcacctgagcctttctccaggaggcagagagtgaattaaaggctggaaaagcagtatctgatgaggctcagttttctgacagcccaccagccccttcctggaccaagtacattttcactacaaagaggtgtgactaatctttcagagcaagtgatattttagaagcagtagttggaccagatgtggtggcgcatgcctgtaatcccagcactttgggaggctaaggcaggagggtcacttgaggccaggagtttgagaccaacttgggcaacatagcaagaccccatctctacaaaaagtaaaaaataaaaattagctgggcatgttgacatgtgcctgtagtcctagctactcaggaggctgaggtagaaggattgcttgagcctaggagtttgaggctgcagtgatcaccactgcactacagcctgggtgacagagtgagatcctgtctcaaaaaaaaaaaaaaaggaagaagcagcagtagtaaaccctgtgaccttgtggccagccagttcatcctgtgaaggaggtctctgctgagtccttttgtaaagtgaagacatcctttagaatgcagtggactgtgtagcatagcggttaagagctctgacttgaggcttaagtgctacttactggctgtctgaacttgggccattcatttgacatcttttaacctcagttttctcatttgtaaaatggaatgaataacactatcgtataggattattgaaaagattaaatgcattaactgcagtattccttgcacattatctggtatatagtaaatgcacagtaaatagcagctgctattatttattgcaaataattacagccattttaatttatagatctgtagaattagagaatcactttgagactaatttaatctccatcttttacaaatgaggaaactaatccagagagggaaggggcttgtcctaagtcaagtggctagttagtgccaggagctggcctggaaccatgagtcatgttcctaatgattgttcatacttacaccatatttacaccccacaaagaacttcttgtcaataacctttctgggctgggtattcactttcctagctggggagtggggcacatggaggtggagagggctggagtgttagagattgagctagaaagccttcaggttctatgggtgaggttgggaagagacacagttacatagttatgggtcttccagtgaagagggatcaccttctggagttctatcctaaaggcttactctcttagacttgaaattctgttgctttttgaatccatctccagactcaagatagggatattgtgtctggaattggtgggttcttggtctcactgatttcaagaatgaagctgcagaccctcgcggtgagtgttacagttcttaaaggcggcgtgtccggagttgttccttctgatgttcagatgtgctcggagtttcttccttctggtgggttcgtggtctcgctggctcaggagtgaagctgcagaccttcatggtgagtgttacagctcttaaggcggcacacctggagttgttcattcctcccgaggtgggttcgtggtctcgctggcttcaggagtgaagctgcagaccttcgcggtgagtgttacagctcataaaggcagtgtggacccaaagagtgagcagtagcaagatttattgcaaagagcgaaagaacaaagcttccacagtgtggaaggggacccaagcgggttgccactgctggctctggcagcttgcttttattctcttatctggccccacccacattctgctgattggtccattttacagagagccgagtggtctgttagacagggtgctgattggtgcgtttacaatccctgagctagacacaaaggttctccacctccccagtagattagctagatacagagtgtagacacaaaggttctccaagtccccaccagagtagctagatacagagtgctgattggtgtatttacaatctcttagctagacatagaggttctccaagtccccatcagactcaggagcccggctggcttcaaccagtggatcctgcactggggccgcaggtggagctgcctgccagtcccctgccatgcacccgcattcctcagcccttgggtggtcgatgggactgggcgccgtggagcagggggcagcgctccttggggaggttggggccacacaggagcacccatgggtgggggtgggagggcggggaggctcccgcatggcaggctgcagatccggagccctgccccgtgggaaggcagctaaggcccagcaagaaattgagcacagcagctgctggcccaggtgctaagcccctcactgcctggggccagctggctgctccagagtatggggcccgcctagcccacacccacccgctgagcccatgcccacccagaactcgcgctggcccgcaagcactgcccgcagccctggttcccacccacgcctctccctccacacctcccagcaagctgagggagccggctcccaccttggccagcccagaaaggggctcccgcagtgcagcggcgggctgaagggctcctcaagtgctgccaaagtgggagcccaggcagaggaggtgccgagagcaagcgagggctgtgagggctgccagcacgctgtcacctctcaatatcttccagggaggaaaggtgctgggggaaggatgggctgcacaggaccttccacctgatttgtgatgtttattttctgtcattgaaaagttaaacgggtgaaagacctgaagcaagtatggcagagggtgatcattggtactgtgtggtgctgcagtgttttgcttttttctgtttaatttctcaaaaaagtcagtcacatatgcagttagccaggcagtttaaagataaactgtcagtcacatactttagagcagtgttttattttattttttatgtttctgggaagcatcaactccttggagaatctgattaagctaatgattctttttctgaaaaaaactgcttttgaaaaatgtttacaaagaatgagaaggagctccatgagccaacgtggaatgatttcctgcatatatatagttaagtgttaaaaaaaaaaaaaaaagtaagagtatctatagtattccacccttcatataagaaacaaggagatattaaaaaattcatgtatttgcttatttgtgcagagaaaatacaagaaagataaacctgaaactgaagagaaacctagggtgaatgggaagaaaggggcatgaaaatagcataatacggaggagagtgacatttctctgagcatacttttctgagttttctctcagaactatagtgatagctcacaaactcagaaagtaaataagtaattaaaagtaaccatgatgtgggggaacccaaaatggaaaacaaaaatttacaaatgaaaattagccaggcatggtgatgtgcctgtaattccagctacttcagaggctgaggcgggagaagcgcttgaacgcaggtggcggaggttgcagtgagctgtgccacactgcactccagcctgggcgacagagccatagtctaaaaaaaaagttacaagttacaaatgagcctgtgttacaagtgagtaatgtaaccacactgaagggcacgtagaagaaaagaactgaagtaactggaaaacagtattttgcctggatactctgaggctaaagacagaactttacacaaatactgtgtgctattagtaaatttgtttctcacaggggtatgggttagaagttcagaaactgtgtatactaagattgaacaaatacagaaatacatgttagataataagagccagctttctccttctttgagaaagaagttacaaataagaaacagaggaaggttagaatgaaccatgtgatgttagattggaattgatctatcagtatgaactcttggctttttaatagatatgtagatagatacagaattaaacagatttgtgtgtgtgtggtgggggtggttagtatacataactgtattttctagctctgtctgctgagaagttctggaagaaataatactccaacagcaatgaacttagagcctagttcctggttttaagtaccattccccaataaaagcaaccagggctccttggagaaaggcttgatccctagggctgggcagagaagacacaagaggatagatatcttgtgttgcagaaagtagataattactcaaaaagttggaggcatgttgaaagagcacaaaaactaacccaaagaagcccccagtggccaaatttggaacactttgagcagcaaaataactaatgatagtagtggattataaccatagcataaaagataccaatgagttgtactgatacaagtaattgaaggagtaaataaatgggcagaaggaacaggcagcgcgtagaccaccctgaaaaccatcttctgccaaaagagtcagcaaacttcctgtaaaggactggatagtaaagatttggggccttatgggtcatatctctggcccaaccactcagctctgcttttgtagtgcagaaacaatcatagacattacctaaacaagtgggcatggctatgttccagtaaaacttatttacaaaaacaagggaccttagtttgttgaccctgttctagagactgcctctttagaagattaggtgtctttcactatttacacagtagatcttgttgagttttaggggtaggagggcttcagttgagatgattgtactctgtagctctgacaacatatacttcttggtgcaatttaagaattgcagatttagagagaggtggcttattttgtctcttgttcagatcttgtttttgtgtgcatattctatatagtggtatgtagtatagattttgcaatcagacacaactggcatggaaaactagctttgttttcactagctgtaggaccttggacaagtcgctcaacttctctgagtctccatttcctcatatgtaaaatagtaatgttgttgttagctacaaggacagaattttagatgatccactaagaggaaaagagatattctgcatatatcttctctagggggaaaatgggtgagtccgtttaggagttattgttgatctggggtgactataggactgtggttgttaacacctaggaagacctccgtgtggatggccgtggctgtgaggactaccgatgtgtcgaagtggaaactgatgtggtgtccaacactagtgggtccgccagggtcaagctgg

SEQ ID NO: 230 - DNA, 3246 bp, Homo sapiens
gtcatgttggcaagagctgggtctaggaccctggggtggggactggagggttgagcaggtcggggcctcagcctccctccggttccccagggaggtctgttccatccgcttcctgttcacggctgtgtcgctgctgagcctctttctgtcaggtgaggggcagtgaattccctggagcccctgccctgggtgctttggaggcaaacccagcacattttctcctacatcctcggtcctgcagctcctggcattcccctgcagaaccccctaattccccctcagactcccacggtcctccccaggcttaaccccctcaagcctctttccactgtccccctatgccggggaaacccattctcttccttttccttctgagacccctccctctctttctccagcattctggctggggcttctgtacctggtctctcctttggagaatgtgagttggggagactgtcttggggtagggggttggcaggttgtgaacccggagattgtgggggtcccctggactgtcggtctgctggggtgggggtagtgccagaggctacaatccttaagaaagggctggatataaacagacttatgagggattgtgcttgagggtctcttgggggctctgatactgggaggtcaaggaggagtcgaggaaaggggacacagtcttcaaaaaggaagccctggccgtttccaggctgaggtaggagcaaggacgacgggagctgagcggctctgtgttttgtcccttcatccaacaggaacctaaggagatgctgactctaaggtgaaagagggcacctagggtgggaaattggggggctcaaagttgcttctttgagaaccttgaaggcgtgggggcctttgggaggtgtccagggggacagggagccaaccccacggcgcccacctcccacctccagtgagtaccacgagcgcgtgcgctcccaggggcagcagctgcagcagctccaggccgagctggataaactccacaaggaggtgtccactgttcgggcagccaacagcgaggtgagccccggcccaccttggaaacccctgatggatccctgctcccagggtcctgagacttaagctccgcccagagccctgcgggatttctcccggtgcccacgaagtccatcccaaagcaaccagctcccagaggtcccgtccacctgtaaaagcagcccgcaagcctcgcccctccaggcctcgccctccctccttgcagagagtggccaagctcgtgttccagaggctgaatgaggattttgtgcggaagcccgactatgctttgagctctgtgggtaagacccggagacactggaagacagagacgcagacaggaaagaggccaagacactgacacagacagacccatgcacctgaccggccgaagacagagcctcggacagcccccacccgcccccagcccccgcgcccccgcgccccgactcccggcaaggcctgggagcctctgagggttacttctcactgttccaggagcctccatcgacctgcagaagacatcccacgattacgcagacaggaacactgcctacttctggaatcgcttcagcttctggaactacgcacggccgcccacggttatcctggaggtgagtctggaaacatcccgggatgggaccccgggcgggacgctgggaaaagcaccaaaaccccgccctacaggcggagcttggctgagccgagggcgtggaggatggcgtttaactcaaggagagacctggcattgctggggactggggcgggctggaggtggagctctgggcgggtcgatggatggggtcgagctgaggcccgggctggggagcggcagcagtcgctctgtccgacggttccgatggtccctccgcccgcctgcagccccacgtgttccctgggaattgctgggcttttgaaggcgaccaaggccaggtggtgatccaactgccgggccgagtgcagctgagcgacatcactctgcagcatccaccgcccagcgtggagcacaccggaggagccaacagcgccccccgcgatttcgcggtctttgtgagtgcggacgaggtcaggaggtgggggattttgcctagagagcccaagcagtcttgagaactggtgccgttatctgagtcttcgcttgctcatctataaaatgaagatactactatttgcctctcagagctgctgtaggttatagtcataaccatatccagatattagttattgcttgcaaagcacttactccgtgccaagcagtttacaggcattcttattttgctgttgtttttgagacagtctcgctcttgtcacccaggctgctggagtgcagtggtgccatctcagctcacctgcaacctcagcctctaggattcaagcgattcttgtgcctcatcctcccgagtagctggaattacaggcgtgcgccaccatgctcggctaatttttgtatttttagtagagatggggtttcaccatgttggccaggatggtctcaaactcctgacctcaagtgatccgccttcctcggccttctgaaatgctaggattacaggcatgagccaccgtgcctgctttgcacccacataacaacctatgatgtactgttatctccccctttaaagatgaagaaagtaatgctcagagaggggaagttatttttccaaggtaatacaactaacagttggcaggattaaatttaaaacctggtttcttcccgggaggtggagcttgcagtgagccaagatctcaccactgcactccagcctgggtgacagagcaacactccgtctcaaaataaataaataaataaaacctggtttcttagagcccacattctgaattacagtgtacgaccatcaaaaaatacatgagaacatgcatatagctattgaatacacagaagatcctcagcaaagttttcttctccccgccccccccgccccacctgtccccctcatagttcctcctttcattcttcacccaccagggcctccaggtttatgatgaaactgaagtttccttggggaaattcaccttcgatgttgagaaatcggagattcagactttccacctgcaggtgtgtttgtctctagggtgaaggtgccaagggagtggggcagtgagggatgaatgatccaggaggagggcagcccttggcatgatccatttgtctccccagaatgaccccccagctgcctttcccaaggtgaagatccagattctaagcaactggggcca

SEQ ID NO: 231 - DNA, 506 bp, Homo sapiens
gtgcagaagtctctctcagtcaggacacagcatggacatgagggtccctgctcagctcctgggactcctgctgctctggctcccaggtaaggagggaaacaacaaaaattttattcagccagtgtagccactaatgcctggcacttcaggaaattcttcttagaacattactaatcatgtggatatgtgtttttatgttcctaatatcagataccagatgtgacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccct
